US010499651B2

(12) United States Patent
Gonzalez et al.

(10) Patent No.: US 10,499,651 B2
(45) Date of Patent: Dec. 10, 2019

(54) METHOD FOR TREATMENT AND CONTROL OF PLANT DISEASE

(71) Applicant: The Texas A&M University System, College Station, TX (US)

(72) Inventors: Carlos F. Gonzalez, College Station, TX (US); Stephen J. Ahern, College Station, TX (US); Mayukh Das, College Station, TX (US); Ryland F. Young, III, College Station, TX (US); Tushar Suvra Bhowmick, College Station, TX (US)

(73) Assignee: The Texas A&M University System, College Station, TX (US)

( * ) Notice: Subject to any disclaimer, the term of this patent is extended or adjusted under 35 U.S.C. 154(b) by 24 days.

(21) Appl. No.: 15/174,589

(22) Filed: Jun. 6, 2016

(65) Prior Publication Data
US 2016/0309723 A1 Oct. 27, 2016

Related U.S. Application Data

(63) Continuation-in-part of application No. 14/057,851, filed on Oct. 18, 2013, now Pat. No. 9,357,785.

(60) Provisional application No. 61/785,535, filed on Mar. 14, 2013, provisional application No. 61/716,245, filed on Oct. 19, 2012.

(51) Int. Cl.
*A01N 63/00* (2006.01)
*C12N 15/82* (2006.01)
*C12R 1/91* (2006.01)
*C12N 7/00* (2006.01)

(52) U.S. Cl.
CPC .............. *A01N 63/00* (2013.01); *C12N 7/00* (2013.01); *C12N 15/8281* (2013.01); *C12R 1/91* (2013.01); *C12N 2795/10121* (2013.01); *C12N 2795/10131* (2013.01); *C12N 2795/10221* (2013.01); *C12N 2795/10231* (2013.01); *C12N 2795/10321* (2013.01); *C12N 2795/10331* (2013.01)

(58) Field of Classification Search
None
See application file for complete search history.

(56) References Cited

U.S. PATENT DOCUMENTS

| | | | |
|---|---|---|---|
| 2005/0175594 A1* | 8/2005 | Loessner | A23G 9/30 424/93.6 |
| 2009/0036307 A1 | 2/2009 | Gabriel et al. | |
| 2009/0180992 A1* | 7/2009 | Summer | C09K 8/54 424/93.6 |
| 2009/0246336 A1 | 10/2009 | Burnett et al. | |
| 2011/0294668 A1 | 12/2011 | Melander et al. | |
| 2012/0020940 A1 | 1/2012 | Durner et al. | |
| 2012/0177608 A1 | 7/2012 | Ross et al. | |
| 2015/0257392 A1 | 9/2015 | Gonzalez et al. | |
| 2016/0302426 A1 | 10/2016 | Gonzalez et al. | |

FOREIGN PATENT DOCUMENTS

| | | |
|---|---|---|
| WO | WO 1990/013631 | 11/1990 |
| WO | WO 2008/062310 | 5/2009 |

OTHER PUBLICATIONS

Ackermann, Bacteriophage observations and evolution, Research in Microbiology 154 (2003) 245-251.*
Lavigne, Classification of Myoviridae bacteriophages using protein sequence similarity, BMC Microbiology 2009, 9:224.*
USPTO: Advisory Action regarding U.S. Appl. No. 14/433,852, dated May 23, 2018.
Supplemental Response to Final Office Action regarding U.S. Appl. No. 14/433,852, dated Jun. 4, 2018.
Jonczyk et al., "The influence of external factors on bacteriophages—review," *Folia Microbiol* 56:191-200, 2011.
Kerby et al., "Purification, pH Stability and Sedimentation Properties of the $T_7$ Bacteriophage of *Escherichia coli*," *J Immunol* 63:93-107, 1949.
Ly-Chatain, "The factors affecting effectiveness of treatment in phages therapy," *Frontiers in Microbiology—Virology* 5:1-7, 2014.
Meyer et al., "Stabilization of T4 bacteriophage at acidic and basic pH by adsorption on paper," *Colloids and Surfaces B: Biointerfaces* 160:169-176, 2017.
USPTO: Non-Final Office Action regarding U.S. Appl. No. 14/433,852, dated Mar. 20, 2017.
Gonzalez et al., "Bacteriophage and Bacteriocins of *Xylella fastidiosa*: Potential Biocontrol Agents," *Proceedings of the Pierce's Disease Research Symposium*. pp. 160-163, 2008. Retrieved from the Internet http://static.cdfa.ca.gov/PiercesDisease/proceedings/2008/2008_160-163.pdf, on Jul. 28, 2017.
U.S. Appl. No. 15/174,564, filed Jun. 6, 2016, Gonzalez et al.
USPTO: Non-Final Office Action regarding U.S. Appl. No. 15/174,564, dated Mar. 20, 2018.
Ahmad et al., "Characterization of Bacteriophages Cp1 and Cp2, the Strain-Typing Agents for *Xanthomonas axonopodis* pv. citri," *Applied and Environmental Microbiology* 80:77-85, 2013.

(Continued)

*Primary Examiner* — Louise W Humphrey
*Assistant Examiner* — Srikanth Patury
(74) *Attorney, Agent, or Firm* — Dentons US LLP

(57) ABSTRACT

Methods and compositions are provided for preventing or reducing symptoms or disease associated with *Xylella fastidiosa* or *Xanthomonas axonopodis* in a plant. The invention provides novel bacteriophages virulent to *Xylella fastidiosa* or *Xanthomonas axonopodis*, including XfaMija and XfaMijo, and further provides methods for treating or preventing Pierce's Disease or Citrus Canker in plants.

9 Claims, 15 Drawing Sheets
Specification includes a Sequence Listing.

(56) References Cited

OTHER PUBLICATIONS

Chen et al., "Morphological evidence for phages in *Xylella fastidiosa*," *Virology Journal* 5:75, 2008.
Shiotani et al., "Pathogenic Interactions Between *Xanthomonas axonopodis* pv. *citri* and Cultivars of Pummelo (*Citrus grandis*)," *Bacteriology* 90:1383-1389, 2000.
Response to Final Office Action regarding U.S. Appl. No. 14/433,852, dated May 3, 2018.
Ahern et al., "Characterization of novel virulent broad-host-range phages of *Xylella fastidiosa* and Xanthomonas," *J. Bacteriology* 196(2):459-471, 2013.
Balogh et al., "Control of citrus canker and citrus bacterial spot with bacteriophages," *Plant Disease* 92:1048-1052, 2008.
Bextine et al., "Laboratory-based monitoring of an insect transmitted plant pathogen system," *Biotechniques* 38:184, 186, 2005.
Bextine et al., "*Xylella fastidiosa* genotype differentiation by SYBR® Green-based QRT-PCR," *FEMS Microbiology Letters* 276:48-54, 2007.
Brunings et al., "*Xanthomonas citri*: breaking the surface," *Mol. Plant. Pathol.* 4:141-57, 2003.
Casjens et al., "Diversity among the tailed-bacteriophages that infect the Enterobacteriaceae," *Research in Microbiology* 159:340-348, 2008.
Casjens et al., "Determining DNA packaging strategy by analysis of the Termini of the chromosomes in Tailed-bacteriophage virions," *Methods Mol. Biol.* 502:91-111, 2009.
Cursino et al., "Twitching motility and biofilm formation are associated with tonB1 in *Xylella fastidiosa*," *FEMS Microbiology Letters* 299:193-199, 2009.
Dunn et al., "Complete nucleotide sequence of bacteriophage T7 DNA and the locations of T7 genetic elements," *J. Mol. Biol.* 166:477-535, 1983.
Gill et al., "Genomes and Characterization of Phages Bcep22 and BcepIL02, Founders of a Novel Phage Type in *Burkholderia cenocepacia*," *J. Bacteriol.* 193:5300-5313, 2011.
Hendson et al., "Genetic diversity for Pierce's disease strains and other pathotypes of *Xylella fastidiosa*," *Applied and Environmental Microbiology* 67(2):895-903, 2001.
Hernandez-Martinez et al., "Differentiation of strains of *Xylella fastidiosa* infecting grape, almonds and oleander using a multiprimer PCR Assay," *Plant Disease* 90(11):1382-1388, 2006.
Hernandez-Martinez et al., "Phylogenetic Relationships of *Xylella fastidiosa* Strains Isolated from Landscape Ornamentals in Southern California," *American Phytopathological Society* 97(7):857-864, 2007.
Hill et al., "Multiplication and movement of *Xylella fastidiosa* within grapevine and four other plants," *Phytopathology* 85(12):1368-1372, 1995.
Hopkins et al., "Biological control of Pierce's disease in the vineyard with strains of *Xylella fastidiosa* benign to grapevine," *Plant Dis.* 89:1348-1352, 2005.
Jones et al., "Bacteriophages for plant disease control," *Ann. Rev Phytopathol.* 45:245-262, 2007.
Kasman et al., "Overcoming the phage replication threshold: a mathematical model with implications for phage therapy," *J. Virol.* 76(11):5557-5564, 2002.
Lavigne et al., "The genome of bacteriophage phiKMV, a T7-like virus infecting *Pseudomonas aeruginosa*," *Virology* 312:49-59, 2003.
Li et al., "Type I and type IV pili of *Xylella fastidiosa* affect twitching motility, biofilm formation and cell-cell aggregation," *Microbiology* 153:719-726, 2007.

Li et al., "Genome-wide mutagenesis of *Xanthomonas axonopodis* pv. *citri* reveals novel genetic determinants and regulation mechanisms of biofilm formation," *PLoS ONE* 6:e21804, 2011.
Nocker, "Comparison of propidium monoazide with ethidium monoazide for differentiation of live vs. dead bacteria by selective removal of DNA from dead cells," *J Microbiol Meth.* 67(2):310-20, 2006.
Nunney et al., "Population Genomic Analysis of a Bacterial Plant Pathogen: Novel Insight into the Origin of Pierce's Disease of Grapevine in the U.S.," *PLoS ONE* 5(11):e15488, 2010.
Roine et al., "Characterization of Type IV Pilus Genes in *Pseudomonas syringae* pv. *tomato* DC3000," *Mol. Plant Microbe Interact.* 11:1048-1056, 1998.
Sherald et al., "Sycamore leaf scorch: culture and pathogenicity of fastidious xylem-limited bacteria from scorch-affected trees," *Plant Disease* 67:849-852, 1983.
Summer et al., "Preparation of a phage DNA fragment library for whole genome shotgun sequencing." In: Clokie, M. and Kropinski, A. (eds.), *Bacteriophages: Methods and Protocols*, vol. 2: *Molecular and Applied Aspects* (Humana Press), pp. 27-46, 2009.
Summer et al., "Genomic and biological analysis of phage Xfas53 and related prophages of *Xylella fastidiosa*," *J. Bacteriol.* 192:179-190, 2010.
Whitehorn et al., "Neonicotinoid pesticide reduces bumble bee colony growth and queen production," *Science* 336:351-352, 2012.
Yang et al., "PilR enhances the sensitivity of *Xanthomonas axonopodis* pv. *citri* to the infection of filamentous bacteriophage Cf.," *Curr. Microbiol.* 48:251-61, 2004.
USPTO, Notification of Transmittal of the International Search Report and Written Opinion of the International Searching Authority for PCT/US2013/065710, dated Apr. 16, 2014.
Wells et al., "*Xylella fastidiosa* gen. nov., sp. nov: Gram-Negative, Xylem-Limited, Fastidious Plant Bacteria Related to *Xanthomonas* app.," *International Journal of Systematic Bacteriology* 37(2):136-143, 1987.
Response to Non-Final Office Action regarding U.S. Appl. No. 14/433,852, dated Aug. 18, 2017.
European Extended Search Report regarding European Application No. EP 13846657, dated Jul. 5, 2016.
Ahern, "Novel virulent phages for *Xylella fastidiosa* and other members of the *Xanthomonadaceae*," Dissertation. Texas A&M University. 2013.
Balogh, "Characterization and use of Bacteriophages Associated with Citrus Bacterial Pathogens for Disease Control," Dissertation. University of Florida. 2006.
Balogh et al., "Control of Citrus Canker and Citrus Bacterial Spot with Bacteriophages," *Plant Disease* 92(7):1048-1052, 2008.
Balogh et al., "Phage Therapy for Plant Disease Control," *Current Pharmaceutical Biotechnology* 11:48-57, 2010.
Das et al., "Control of Pierce's Disease by Phage," *PLOS One* 10(6):e0128902, 2015.
Response to Non-Final Office Action regarding U.S. Appl. No. 15/174,564, dated Sep. 18, 2018.
USPTO: Notice of Allowance and Fee(s) Due regarding U.S. Appl. No. 15/174,564, dated Oct. 2, 2018.
USPTO: Non-Final Office Action regarding U.S. Appl. No. 14/433,852, dated Oct. 10, 2018.
Lauzon, C, R., "A Survey of Insect Vectors of Pierce's Disease (PD) and PD Infected Plants for the Presence of Bacteriophages that Infect Xylella fastidiosa". Glassywinged Sharpshooter & Pierce's Disease Research Summaries, pp. 1-82, Dec. 2001.
USPTO: Final Office Action regarding U.S. Appl. No. 14/433,852, dated Dec. 5, 2017.
USPTO: Notice of Allowance and Fee(s) Due regarding U.S. Appl. No. 14/433,852, dated Jul. 30, 2019.

\* cited by examiner

Fig. 7

| Observation for PD symptoms[§] | Vines Inoculated with XF, Phage, or Buffer | | | Inoculated with XF & Challenged with Phage | | Inoculated with Phage & Challenged with XF-15 |
|---|---|---|---|---|---|---|
| | XF-15 (15)* | XF-54 (15)* | Phage Xfas304*** (24)* | Buffer (6)* | XF-15 (15)* | XF-54 (15)* | (6)* |
| Wk. 0 (10/05/11) | 0*** | 0 | 0 | 0 | 0 | 0 | 0 |
| Wk. 1 (10/12/11) | 0 | 0 | 0 | 0 | 0 | 0 | 0 |
| Wk. 2 (10/19/11) | 1 | 1 | 0 | 0 | 1 | 1 | 0 |
| Wk. 3 (10/26/11) | 2 | 2 | 0 | 0 | 2 | 2 | 0 |
| Wk. 4 (10/31/11) | 3 | 3 | 0 | 0 | 3 | 3 | 0 |
| Wk. 4 (11/04/11) | 5 | 4 | 0 | 0 | 5 | 4 | 0 |
| Wk. 5 (11/07/11) | 7 | 6 | 0 | 0 | 5 | 4 | 0 |
| Wk. 5 (11/11/11) | 9 | 6 | 0 | 0 | 5 | 4 | 0 |
| Wk. 6 (11/14/11) | 9 | 7 | 0 | 0 | 5 | 4 | 0 |
| Wk. 6 (11/18/11) | 10 | 8 | 0 | 0 | 5 | 4 | 0 |
| Wk. 7 (11/21/11) | 10 | 9 | 0 | 0 | 5 | 4 | 0 |
| Wk. 7 (11/25/11) | 11 | 10 | 0 | 0 | 5 | 4 | 0 |
| Wk. 8 (11/28/11) | 11 | 10 | 0 | 0 | 5 | 4 | 0 |
| Wk. 8 (12/02/11) | 11 | 11 | 0 | 0 | 5 | 4 | 0 |
| Wk. 9 (12/05/11) | 12 | 11 | 0 | 0 | 5 | 4 | 0 |
| Wk. 9 (12/09/11) | 12 | 11 | 0 | 0 | 5 | 4 | 0 |
| Wk. 10 (12/12/11) | 12 | 12 | 0 | 0 | 5 | 4 | 0 |
| Wk. 10 (12/16/11) | 12 | 12 | 0 | 0 | 5 | 4 | 0 |
| Wk. 11 (12/19/11) | 12 | 12 | 0 | 0 | 5 | 4 | 0 |
| Wk. 11 (12/23/11) | 13 | 12 | 0 | 0 | 5 | 4 | 0 |
| Wk. 12 (12/26/11) | 12 | 12 | 0 | 0 | 5 | 4 | 0 |
| Wk. 12 (12/30/11) | 12 | 12 | 0 | 0 | 5 | 4 | 0 |

Vines in column 2 and 3 challenged with phage. Vines in column 6 challenged with XF15

* Total No. of vines in each category is within parentheses. Note: 3 vines were harvested at time zero to determine input.
** Phage movement data in vines will be presented separately.
*** Number indicated equals vines exhibiting Pierce's Disease symptoms
[x] Data collected on dates indicated in parentheses.

METHOD FOR TREATMENT AND CONTROL OF PLANT DISEASE

CROSS REFERENCE TO RELATED APPLICATIONS

This application is a continuation-in-part of U.S. patent application Ser. No. 14/057,851, filed Oct. 18, 2013, which claims the benefit of U.S. Provisional Applications No. 61/716,245, filed Oct. 19, 2012, and No. 61/785,535, filed Mar. 14, 2013, the content of each of which is herein incorporated by reference in its entirety.

STATEMENT REGARDING FEDERALLY SPONSORED RESEARCH

The U.S. government has certain rights in this invention, pursuant to the following: Animal & Plant Health Inspection Service (APHIS) Cooperative Agreement Award for the Texas Pierce's Disease Research & Education Program, Agreement Number 11-8500-0955-CA, with AgriLife Research; and Otsuka Pharmaceutical Co., LTD, Agreement number 406039, with AgriLife Research.

INCORPORATION OF SEQUENCE LISTING

The sequence listing that is contained in the file named "TAMC019USCP1_ST25.txt," which is 1,710,969 bytes as measured in Microsoft Windows operating system and was created on May 25, 2016, is filed electronically herewith and incorporated herein by reference.

FIELD OF THE INVENTION

The invention relates to the field of plant pathology. More specifically, the invention relates to methods and compositions for isolating bacteriophage and for treatment of plant diseases caused by *Xylella fastidiosa* and *Xanthomonas axonopodis* comprising use of a bacteriophage, a virus of bacteria.

BACKGROUND OF THE INVENTION

Bacteria can cause many diseases in plants, including Pierce's Disease of grapevines, and Citrus Canker of citrus plants. The bacteria infect plant tissues and can cause wilting, poor growth, lesions on fruit, and even plant death. Infection can occur through spreading by wind, rain, contaminated equipment, or vector insects, rapidly spreading to other plants, and resulting in deleterious effects to the plant and massive crop losses. Effective treatment of these diseases requires a method of treating the plant to eliminate the bacteria.

SUMMARY OF THE INVENTION

In one aspect, the present invention provides a method of propagating a virulent bacteriophage (phage) that includes *X. fastidiosa* in its host range, comprising infecting a culture of *Xanthomonas* bacteria with the bacteriophage, allowing the bacteriophage to propagate, and isolating bacteriophage particles from the culture. In another embodiment, the *Xanthomonas* bacteria comprises species strain EC-12. In another embodiment, the bacteriophage infects the cell by binding to a cell surface feature. In another embodiment, the cell surface feature is a Type IV pilus. In another embodiment, the bacteriophage comprises a tailed bacteriophage from the group consisting of a podophage, a siphophage, and a myophage. In other embodiments, the bacteriophage is isolated from the environment, a sewage treatment plant, or effluent, a plant, or a surface thereof or from the surrounding soil. In other embodiments of the present invention, a surrogate host is used to enrich for virulent bacteriophage. In still another embodiment, the bacteriophage is virulent in *Xylella fastidiosa*. In other embodiments, agar overlaying is used for growth of the bacteriophage.

In another aspect, the invention provides a method of obtaining a candidate biocontrol agent for Pierce's Disease comprising contacting *X. fastidiosa* and *Xanthomonas* bacteria with a sample comprising a population of virulent bacteriophage and isolating at least a first bacteriophage from the population capable of lysing said *X. fastidiosa* and *Xanthomonas* bacteria. In one embodiment, the bacteriophage infects a cell by binding to a cell surface feature. In another embodiment, the cell surface feature is a Type IV pilus. In still another embodiment, the cell surface feature is required for pathogenesis/virulence of the bacterial host. Other embodiments include contacting a lawn of at least one of *X. fastidiosa* and *Xanthomonas* with the sample, contacting the *X. fastidiosa* and *Xanthomonas* with the sample simultaneously, and contacting the *X. fastidiosa* and *Xanthomonas* with the sample sequentially. In other embodiments, the bacteriophage is isolated from the environment, a sewage treatment plant, or effluent, a plant, or a surface thereof or from the surrounding soil. In another embodiment, the bacteriophage used is virulent in *Xylella fastidiosa*. The method may further comprise detecting lysed bacterial host cells, or plaque formation, after contacting host bacteria with the virulent bacteriophage. In particular embodiments, the method comprises a plate agar overlay or a plate of the bacterial host cells onto which a sample of bacteriophage have been introduced.

In other embodiments, the bacteriophage is prepared by use of a soft agar overlay containing the *X. fastidiosa* and *Xanthomonas*, and in further embodiments, high-titer phage plate lysates are prepared by harvesting one or more overlay plate(s) comprising a *X. fastidiosa* strain or a *Xanthomonas* strain, such as EC-12, exhibiting confluent lysis, followed by maceration and clarification by centrifugation. After being filter sterilized, the resulting lysates may be stored, for instance at 4° C. Subsequently, high-titer phage lysates are purified, for instance by isopycnic CsCl centrifugation, and extracted phage solution are dialyzed. The resulting CsCl-purified bacteriophage typically displays a titer of about $1 \times 10^{11}$ PFU/ml.

In some embodiments, a ratio of bacteriophage in plant tissue filtrates (PTFs) is about 1 ml of PTF to 20 ml the surrogate host (actively growing culture of selected host) for 4 days for *X. fastidiosa* strain Temecula or for 4 h for *Xanthomonas* strain EC-12.

Another aspect of the invention provides a method of preventing or reducing symptoms or disease associated with *X. fastidiosa* in a plant, comprising contacting a plant with bacteriophage that includes *X. fastidiosa* in its host range, wherein the symptoms or disease associated with *X. fastidiosa* comprise typical Pierce's Disease (PD) symptoms, wherein the leaves display a yellow or red appearance along margins, with eventual leaf margin necrosis. In one embodiment, the bacteriophage particles may be introduced into the plant. In another embodiment, the plant is selected from the group consisting of a grapevine plant, a citrus plant, almond, coffee, alfalfa, oleander, oak, sweetgum, redbud, elm, peach, apricot, plum, blackberry, mulberry, and *Chitalpa tashkentensis*. In another embodiment, the bacteriophages are introduced into the plant by injection, an insect vector or delivered via the root system by injection. In other embodiments, injection comprises a needle or a needle-free system, a pneumatic air or pressure injection system. In other embodiments, the injection is performed manually, or once, or more than once. In another embodiment, the insect vector is a glassy winged sharpshooter. In another embodiment, the bacteriophage to be introduced into the plant is from 1 to $10^{12}$ PFU/ml (plaque forming units/ml), $10^4$ to $10^{11}$ PFU/ml, and $10^7$ to $10^{10}$ PFU/ml. In another embodiment, the bacteriophage particles are obtained by a method comprising infecting a culture of *Xanthomonas* bacteria with the bacteriophage, allowing the bacteriophage to propagate, and isolating bacteriophage particles from the culture. In another embodiment, the method comprises contacting a population of plants with the bacteriophage particles to prevent or reduce symptoms associated with *X. fastidiosa*. In still another embodiment, the bacteriophage comprises at least one bacteriophage (phage) of a strain selected from the Xfas100 phage type or the Xfas300 phage type, described below.

In another aspect, the invention provides a plant disease biocontrol composition formulated for delivery to a plant, the composition comprising at least one diluent, adjuvant or surfactant, and at least one bacteriophage from the Xfas100 phage type or the Xfas300 phage type, described below. In one embodiment, the composition is further defined as being formulated for introduction to a plant via injection, spraying, misting, or dusting. In another embodiment, the composition is further defined as being formulated for topical administration to a plant.

In another aspect, the invention provides a method of obtaining a candidate biocontrol agent for citrus canker comprising contacting *Xanthomonas axonopodis* pv. *citri* bacteria with a sample comprising a population of virulent bacteriophage and isolating at least a first bacteriophage from the population capable of lysing said *Xanthomonas axonopodis* bacteria. In one embodiment, the bacteriophage infects a cell by binding to a cell surface feature. In another embodiment, the cell surface feature is a type IV pilus. In still another embodiment, the cell surface feature is required for pathogenesis/virulence of the bacterial host. Other embodiments include contacting a lawn of *Xanthomonas* with the sample. In another embodiment, the bacteriophage used is virulent in *Xanthomonas axonopodis*.

Another aspect of the invention provides a method of preventing or reducing symptoms or disease associated with *Xanthomonas axonopodis* in a plant, comprising contacting a plant with bacteriophage that includes *Xanthomonas axonopodis* in its host range. In one embodiment, the bacteriophage particles may be introduced into the plant. In some embodiments, the plant is a citrus plant selected from the group consisting of a *Citrus* spp., a *Fortunella* spp., a *Poncirus* spp., a lime, a lemon, an orange, a grapefruit, a pomelo, and hybrids of trifoliate orange used for rootstocks. In another embodiment, the bacteriophages are introduced into the plant by injection, by an insect vector, or is delivered via the root system by injection. In some embodiments, injection comprises a needle or a needle-free system, a pneumatic air or pressure injection system. In other embodiments, the injection is performed manually, or once, or more than once. In another embodiment, the insect vector is a glassy winged sharpshooter. In another embodiment, the bacteriophage to be introduced into the plant is at a concentration of from 1 to $10^{12}$ PFU/ml (plaque forming units/ml), $10^4$ to $10^{11}$ PFU/ml, and $10^7$ to $10^{10}$ PFU/ml. In another embodiment, the method comprises contacting a population of plants with the bacteriophage particles to prevent or reduce symptoms associated with *Xanthomonas axonopodis* and pathovars thereof in the population. In still another embodiment, the bacteriophage comprises at least one bacteriophage of a strain selected from the Xfas100 phage type or the Xfas300 phage type, described below.

In another aspect, the invention provides an isolated bacteriophage that is virulent to *Xanthomonas axonopodis* a Xfas303 bacteriophage, wherein a representative sample of said bacteriophage has been deposited under ATCC Accession Number PTA-13099. In yet another aspect, the invention provides an isolated bacteriophage that is virulent to *Xanthomonas axonopodis* and/or *X. fastidiosa* as one of bacteriophage selected from the group consisting of: Xfas 101, Xfas102, Xfas103, Xfas104, Xfas105, Xfas106, Xfas107, Xfas108, Xfas 109, Xfas110, Xfas301, Xfas302, Xfas304, Xfas305, and Xfas306, wherein representative samples of said bacteriophage Xfas103, Xfas106, Xfas302, Xfas303, Xfas304, and Xfas306 have been deposited under ATCC Accession Number PTA-13096, PTA-13095, PTA-13098, PTA-13099, PTA-13100, and PTA-13097, respectively.

In certain embodiments, the invention provides a method of preventing or reducing symptoms or disease associated or caused by *X. fastidiosa* or *Xanthomonas axoxonopodis* pv. *citri* in a plant comprising a step of contacting said plant with a virulent bacteriophage which includes *X. fastidiosa* and/or *Xanthomonas axoxonopodis* pv. *citri* in its host range, further wherein the bacteriophage is at least one bacteriophage selected from the group consisting of the Xfas100 phage type, and the Xfas300 phage type.

In some embodiments, the Xfas100 type phage has at least one characteristic selected from the group consisting of (a) the bacteriophage is capable of lysing said *Xylella fastidiosa* and/or *Xanthomonas* bacteria; (b) the bacteriophage infects a cell by binding to a Type IV pili; (c) the phage belongs to a group of tailed bacteriophage exhibiting long non-contractile tails with capsid ranging from 55-77 mm in diameter, a morphology typical of Siphoviridae family; (d) the genomic size of bacteriophage is about 55500 bp to 56200 bp; and (e) the bacteriophage prevents or reduces symptoms associated with Pierce's Disease in a plant or plants.

In further embodiments, the Xfas300 type phage has at least one characteristic selected from the group consisting of: (a) the bacteriophage is capable of lysing said *Xylella fastidiosa* and/or *Xanthomonas* bacteria; (b) the bacteriophage infects a cell by binding to a Type IV pilus; (c) the phage belongs to a group of tailed bacteriophage exhibiting short non-contractile tails with capsid ranging from 58-68 mm in diameter, a morphology typical of Podoviridae family; (d) the genomic size of bacteriophage is about 43300 bp to 44600 bp; and (e) the bacteriophage has an activity of preventing or reducing symptoms associated with Pierce's Disease in a plant or plants.

In certain embodiments, a single type of virulent bacteriophage is introduced into a plant; in other embodiments, a combination of 2, 3, 4, 5, 6, or more virulent bacteriophage isolates or types are introduced into a plant, either simultaneously or sequentially. In certain embodiments, the bacteriophage comprise a genome with a DNA sequence selected from the group consisting of SEQ ID NO:11-24, or a DNA sequence at least 90%, 95%, 98%, or 99% identical thereto. Thus, in certain embodiments, the bacteriophage to be introduced into a plant is selected from the group consisting of: Xfas101, Xfas102, Xfas103, Xfas104, Xfas105, Xfas106, Xfas107, Xfas110, Xfas301, Xfas302, Xfas303, Xfas304, Xfas305, and Xfas306. Plant disease biocontrol compositions formulated for delivery to a plant, and comprising such Xfas100 and/or Xfas300 type bacteriophage are also contemplated. The biocontrol composition may further comprise a carrier. In some embodiments the carrier may comprise a diluent, a surfactant, and/or a buffer.

In another aspect, the invention provides a method of preventing or reducing symptoms or disease associated with *Xylella fastidiosa* or *Xanthomonas* in a plant, comprising contacting said plant with particles of at least one virulent bacteriophage, wherein *Xylella fastidiosa* and/or *Xanthomonas axonopodis* are hosts of the bacteriophage, wherein the bacteriophage is of the Xfas500 phage type, for example a XfaMija or XfaMijo bacteriophage or variants thereof. In one embodiment, said bacteriophage is capable of lysing said *Xylella fastidiosa* and/or *Xanthomonas* bacteria. In other embodiments, said bacteriophage infects a cell by binding to a Type IV pilus. In further embodiments, said bacteriophage comprises a contractile tail with a capsid size ranging from 85 nm to 95 nm in diameter and belongs to the Myoviridae family. In yet further embodiments, the genomic size of said bacteriophage is about 190,000 bp to 230,000 bp.

In certain embodiments, said bacteriophage prevents or reduces symptoms associated with Pierce's Disease in a plant or plants. In other embodiments, contacting comprises introducing the bacteriophage particles into the plant, for example by injection, by an insect vector, via the root system, by spray, by mist, or by dust on the plant. In further embodiments, said plant is selected from the group consisting of a grapevine plant, a citrus plant, almond, coffee, alfalfa, oleander, oak, sweetgum, redbud, elm, peach, apricot, plum, blackberry, mulberry, olive, and *Chitalpa tashkentensis*. In yet further embodiments, said insect vector is a glassy winged sharpshooter. The number of said bacteriophage to be introduced into said plant may be from 1 to $10^{12}$ PFU/ml, or from $10^4$ to $10^{11}$ PFU/ml, or from $10^7$ to $10^{10}$ PFU/ml. In certain embodiments, said bacteriophage virulent to *Xylella fastidiosa* and *Xanthomonas* species are introduced simultaneously or sequentially to the plant by a combination of two, three, four, five, or six virulent bacteriophage strains.

In certain embodiments, said virulent bacteriophage comprises at least one bacteriophage strain selected from the group consisting of: XfaMija and XfaMijo, wherein representative samples of said phage have been deposited under ATCC Accession Numbers ATCC PTA-122743 and ATCC PTA-122742, respectively (the "Deposited Bacteriophage"). The invention further contemplates variants of the Deposited Bacteriophage, which are bacteriophage having minor variation(s) in the genomic sequence and polypeptides encoded thereby while retaining the same general genotypic, phenotypic characteristics and lytic activity against *Xylella fastidiosa* and/or *Xanthomonas* bacteria as the Deposited Bacteriophage. For example, said bacteriophage may be a XfaMija (Xfas501) type bacteriophage and displays the following characteristics: (a) the bacteriophage is capable of lysing said *Xylella fastidiosa* and/or *Xanthomonas* bacteria; (b) the bacteriophage infects a cell by binding to a Type IV pilus; (c) the bacteriophage comprises a contractile tail with a capsid size ranging from 85 nm to 95 nm in diameter and belongs to the Myoviridae family; (d) the genomic size of the bacteriophage is about 190,000 bp to 230,000 bp; and (e) the bacteriophage prevents or reduces symptoms associated with Pierce's Disease in a plant or plants. Said bacteriophage may also be a XfaMijo (Xfas502) type bacteriophage and displays the following characteristics: (a) the bacteriophage is capable of lysing said *Xylella fastidiosa* and/or *Xanthomonas* bacteria; (b) the bacteriophage infects a cell by binding to a Type IV pilus; (c) the bacteriophage comprises a contractile tail with a capsid size ranging from 85 nm to 95 nm in diameter and belongs to the Myoviridae family; (d) the genomic size of the bacteriophage is about 190,000 bp to 230,000 bp; and (e) the bacteriophage prevents or reduces symptoms associated with Pierce's Disease in a plant or plants.

In another aspect, the invention provides a plant disease biocontrol composition formulated for delivery to a plant, comprising at least one carrier and at least one virulent bacteriophage selected from the group consisting of: XfaMija and XfaMijo; wherein said bacteriophage is virulent to *Xylella fastidiosa* and *Xanthomonas axonopodis* species. In some embodiments, the carrier is a non-naturally occurring carrier. Plant disease biocontrol compositions of the present invention may increase the virulence of said bacteriophage relative to the same bacteriophage in the absence of said composition, and may maintain the virulence of said bacteriophage for a longer period of time relative to the same bacteriophage in the absence of said composition. Plant disease biocontrol compositions provided by the invention may further comprise at least one additional bacteriophage isolate or type, and may be formulated for introduction to a plant via injection, spraying, misting, or dusting, for example for topical administration to a plant.

In another aspect, the invention provides a method of propagating a virulent bacteriophage that includes *Xylella fastidiosa* or *Xanthomonas axonopodis* in its host range, comprising infecting a culture of Xanthomonadaceae bacteria with at least one virulent bacteriophage selected from the group consisting of: XfaMija and XfaMijo, allowing said bacteriophage to propagate, and isolating virulent bacteriophage particles from the culture. In some embodiments, said virulent bacteriophage is isolated from the environment, for example from a sewage treatment plant or effluent therefrom or from a plant or a surface thereof or from the surrounding soil. In certain embodiments, a surrogate host is used to enrich for said virulent bacteriophage. In further embodiments, agar overlaying is used for growth of said bacteriophage. In yet further embodiments, said virulent bacteriophage is selected from the group consisting of: XfaMija and XfaMijo; wherein representative samples of said phage have been deposited under ATCC Accession Numbers ATCC PTA-122743 and ATCC PTA-122742, respectively.

BRIEF DESCRIPTION OF THE DRAWINGS

For a more complete understanding of the features and advantages of the present invention, reference is now made to the detailed description of the invention along with the accompanying figures and in which:

FIG. 7: Shows a summary of the grapevine bacteriophage therapeutic and preventative challenge study.

BRIEF DESCRIPTION OF THE SEQUENCE LISTING

Figure 1:
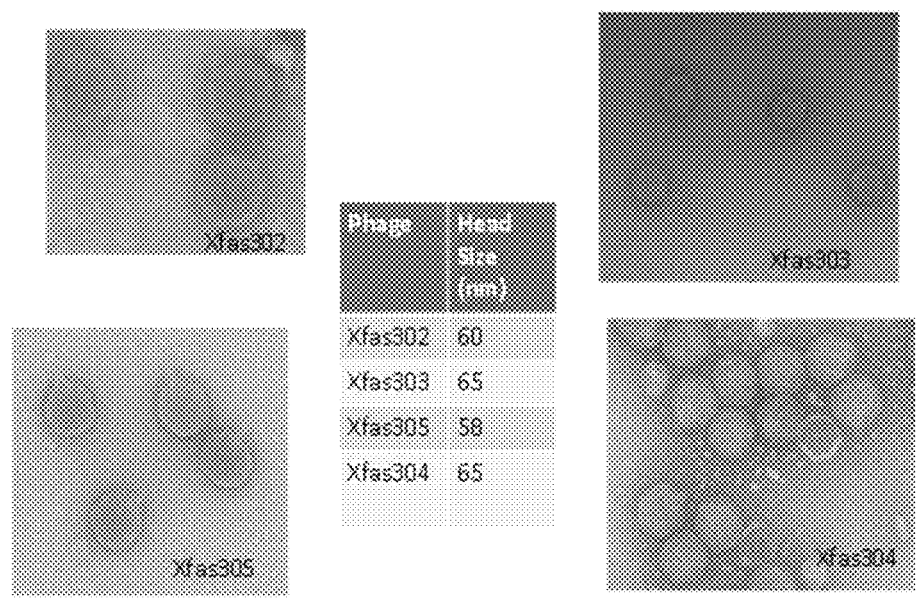
FIG. 1: Shows a TEM image of phages Xfas302, Xfas303, Xfas304, and Xfas305, with morphology and size characteristic of Podoviridae.

SEQ ID NO:1—The *X. fastidiosa*-specific oligonucleotide forward primer designed for *X. fastidiosa* gyrB.

SEQ ID NO:2—The *X. fastidiosa*-specific oligonucleotide reverse primer designed for *X. fastidiosa* gyrB.

SEQ ID NO:3—The bacteriophage Xfas304-specific oligonucleotide forward primer designed for the bacteriophage DNA primase gene.

SEQ ID NO:4—The bacteriophage Xfas304-specific oligonucleotide reverse primer designed for the bacteriophage DNA primase gene.

SEQ ID NO:5—The bacteriophage Xfas303-specific oligonucleotide forward primer designed for the bacteriophage DNA primase gene.

SEQ ID NO:6—The bacteriophage Xfas303-specific oligonucleotide reverse primer designed for the bacteriophage DNA primase gene.

SEQ ID NO:7—The bacteriophage Xfas103-specific oligonucleotide forward primer designed for the bacteriophage DNA helicase gene.

SEQ ID NO:8—The bacteriophage Xfas103-specific oligonucleotide reverse primer designed for the bacteriophage DNA helicase gene.

SEQ ID NO:9—The bacteriophage Xfas106-specific oligonucleotide forward primer designed for the bacteriophage DNA helicase gene.

SEQ ID NO:10—The bacteriophage Xfas106-specific oligonucleotide reverse primer designed for the bacteriophage DNA helicase gene.

SEQ ID NO:11—The genomic sequence of bacteriophage Xfas101.

SEQ ID NO:12—The genomic sequence of bacteriophage Xfas102.

SEQ ID NO:13—The genomic sequence of bacteriophage Xfas103.

SEQ ID NO:14—The genomic sequence of bacteriophage Xfas104.

SEQ ID NO:15—The genomic sequence of bacteriophage Xfas105.

SEQ ID NO:16—The genomic sequence of bacteriophage Xfas106.

SEQ ID NO:17—The genomic sequence of bacteriophage Xfas107.

SEQ ID NO:18—The genomic sequence of bacteriophage Xfas110.

SEQ ID NO:19—The genomic sequence of bacteriophage Xfas301.

SEQ ID NO:20—The genomic sequence of bacteriophage Xfas302.

SEQ ID NO:21—The genomic sequence of bacteriophage Xfas303.

SEQ ID NO:22—The genomic sequence of bacteriophage Xfas304.

SEQ ID NO:23—The genomic sequence of bacteriophage Xfas305.

SEQ ID NO:24—The genomic sequence of bacteriophage Xfas306.

SEQ ID NO:25—The bacteriophage Mija-specific oligonucleotide forward primer designed for the bacteriophage DNA primase gene.

SEQ ID NO:26—The bacteriophage Mija-specific oligonucleotide reverse primer designed for the bacteriophage DNA primase gene.

SEQ ID NO:27—The bacteriophage Mijo-specific oligonucleotide forward primer designed for the bacteriophage DNA primase gene.

SEQ ID NO:28—The bacteriophage Mijo-specific oligonucleotide reverse primer designed for the bacteriophage DNA primase gene.

SEQ ID NO:29—The genomic sequence of bacteriophage Mija.

SEQ ID NO:30—The genomic sequence of bacteriophage Mijo.

DETAILED DESCRIPTION OF THE INVENTION

The following definitions and methods are provided to better define the present invention and to guide those of ordinary skill in the art in the practice of the present invention. Unless otherwise noted, terms are to be understood according to conventional usage by those of ordinary skill in the relevant art.

The invention provides, for the first time, methods allowing efficient propagation and isolation of bacteriophage (phage) capable of infecting, replicating within, and lysing *X. fastidiosa* and/or *Xanthomonas axonopodis* (Xa) and pathovars thereof. The invention also provides a method for controlling bacterial disease in plants. Plant diseases that may be controlled in accordance with the present invention may include, but are not limited to, Pierce's Disease and citrus canker. Bacterial species useful in accordance with the invention may include, but are not limited to, a *Xylella* species, such as *Xylella fastidiosa*, or a *Xanthomonas* species, such as *Xanthomonas axonopodis* and pathovars thereof, such as *Xanthomonas axonopodis* pv. *citri* (Xac).

As used herein, a "bacteriophage" or "phage" refer to a virus of bacteria. As used herein, "*Xanthomonas axonopodis*" or "Xa" refers to a *Xanthomonas axonopodis* bacterial species or pathovar thereof, which may include *Xanthomonas axonopodis* pv. *citri* (Xac) or any other pathovar of *Xanthomonas axonopodis*. Currently, propagation of bacteriophage capable of lysing *X. fastidiosa* is labor-intensive in the laboratory, using *X. fastidiosa* host cells and complex, expensive media in a solid format. This may require 7-10 days to yield low quantities of bacteriophage. The present invention thus represents a significant advance, providing for propagation of bacteriophage capable of infecting *X. fastidiosa* by growing the bacteriophage in a fast-growing host bacteria such as *Xanthomonas* species EC-12 to rapidly produce bacteriophage; this is designated as the "surrogate host" approach. The technique is fast and cost-effective, capable of use with conventional media components available in the art. The technique is also amenable to scale-up. The ability to produce virulent phages that lyse (kill) *X. fastidiosa* and/or Xa in a surrogate host that can replicate hourly under standard conditions, instead of days using a host that at best replicates daily in a very complex media makes viable for the first time the production and implementation of *X. fastidiosa*- and/or *Xanthomonas axonopodis*-mediated disease control and treatment methods comprising use of virulent phages. Culture of Xa can be performed in nutrient broth with a generation time of approximately 2-3 hours. However, Xa is a permitted pathogen and thus requires a biosafety level of 2 (BL2) to culture. Therefore, similar to *X. fastidiosa*, Xa may not be practical for large-scale production.

Bacteriophage may be isolated by a soft agar overlay method, allowing for isolation of phage from *X. fastidiosa* and/or *Xanthomonas* cells, and in further embodiments, high-titer phage plate lysates are prepared by harvesting one or more overlay plate(s) of a *X. fastidiosa* strain or a *Xanthomonas* strain, such as strain EC-12, exhibiting confluent lysis, followed by maceration, clarification by centrifugation, and filter sterilization. The resulting lysates may be stored at 4° C. Subsequently, high-titer phage lysates may be purified for instance by isopycnic CsCl centrifugation, and extracted phage solution can be dialyzed. Resulting CsCl-purified bacteriophage having a titer of about $1 \times 10^{11}$ PFU/ml can thus be obtained. In other embodiments, bacteriophage in plant tissue filtrates (PTFs) may be filtered. A preferred ratio for filtration is 1 ml of PTF to 20 ml of the surrogate host culture (an actively growing culture of a selected host), grown, for instance, for 4 days for *X. fastidiosa* strain Temecula or for 4 h for *Xanthomonas* strain EC-12.

Using methods for the detection and propagation of bacteriophage virulent to *X. fastidiosa* and/or *Xanthomonas axonopodis* ("Xa") pathovars, virulent bacteriophage which are capable of causing lysis of *X. fastidiosa* and/or Xa can be selected from a desired source, such as from the environment, including plants, wastewater, and/or soil water, and propagated according to the invention. Bacteriophages that may be identified in accordance with the present invention may be defined by particular characteristics as described by Casjens et al. (*Research in* Microbiology, 159:340-348, 2008), such as capsid shape and size, genome size, arrangement of genes and/or gene modules, morphology, and life cycle. In one embodiment, bacteriophages of the present invention may be virulent, isometric, with a triangulation number of T=7, a genome size of about 60 kb or within about 15% of 60 kb, may include direct terminal repeats in the genome. The virulent bacteriophage can be used, for example, to control and prevent disease cause by *Xylella* species and subspecies and/or *Xanthomonas* species such as *Xanthomonas axonopodis* and pathovars thereof, such as *citri*.

Currently, five subspecies of *Xylella* are recognized as causing plant disease. Plant species able to be infected by *Xylella* are listed, for example, at www.cnr.berkeley.edu/xylella/control/hosts.htm, as described in Hernandez-Martinez et al., (*American Phytopathological Society,* 97(7):857-864, 2007) and Nunney et al., (*PLoS ONE,* 5(11):e15488, 2010), and may include commercial crops such as, but not limited to, grapevines, citrus, coffee, almond, peach, alfalfa, apricot, plum, blackberry, mulberry, olive and horticultural plants such as oleander, oak, sweetgum, redbud, elm, and *Chitalpa tashkentensis*. In one embodiment of the invention, bacteriophage can be isolated from environments where *X. fastidiosa* is unable to grow because of its unique growth requirements. Further, in accordance with the present invention, plant species able to be infected by a *Xanthomonas axonopodis* pathovar may include, but are not limited to, a *Citrus* spp., a *Fortunella* spp., a *Poncirus* spp., a lime, a lemon, an orange, a grapefruit, a pomelo, and hybrids of trifoliate orange used for rootstocks.

The invention thus provides methods for development of bacteriophage-based treatments for the control of plant diseases caused by *X. fastidiosa*, which is a xylem-limited, insect vectored, Gram-negative bacterium that causes disease in many plants. Most notably, *X. fastidiosa* is the causal agent of Pierce's Disease (PD) of grapes, which is currently a limiting factor in the cultivation of high quality wine grapes in areas of the U.S., including Texas and California. One important plant disease caused by *X. fastidiosa* is Pierce's Disease of grape, which causes visible symptoms including yellowed leaves, or leaves with red along margins. Eventually drying and necrosis of leaf margins and leaves may occur. Insect vectors such as the leafhopper Glassy Winged Sharpshooter ("GWSS") may spread the disease, as well as phage which infect the disease-causing bacteria and which may be useful for biocontrol efficacy.

Presently, there are no effective control measures for PD short of aggressive culling of the infected vines. The current invention permits treatment of such diseases by providing, for the first time, a viable system for generating sufficient bacteriophage quantities in a cost-effective manner to permit plant treatments. The invention also provides methods for development of bacteriophage-based treatments for the control of plant diseases caused by Xa, including Xac, which is the causal agent of citrus canker. In a particular embodiment, the invention provides a method for controlling disease of Xa in a plant.

As used herein, the term "virulent" refers to a virus, particularly a bacteriophage, that is able to infect, replicate within, and lyse (kill) a host cell. The term "temperate" refers to a bacteriophage that can integrate into the host genome (lysogenize) or lyse the host cell. In one embodiment of the invention, phages are propagated in a suitable host, as is described herein. The term "host" refers to a bacterial cell that can be used to produce large quantities of bacteriophage. One step in the development of a bacteriophage-based control strategy provided herein is the identification and propagation of virulent phages that recognize particular bacterial receptor sites. Production and delivery of bacteriophage virulent to disease-causing bacteria must be economical to represent a viable biocontrol option.

Phages infect a host cell via recognition of receptors, which can include, but are not limited to, surface proteins such as Omp A and OmpF, the core and O-chain of the bacterial LPS in Gram-negative bacteria, sex and type IV pili (e.g. Roine et al., *Mol. Plant Microbe Interact.*, 11:1048-1056 (1998)), and flagella. Without being limited to any given theory, it is believed that bacteriophage may infect *X. fastidiosa* and Xa cells via type IV pili. Thus, in one embodiment, a host according to the present disclosure may be any type of bacteria, and particularly any bacterial species that a virulent temperate bacteriophage, or a derivative thereof, such as a passaged phage, is able to adsorb to and infect via a surface receptor that is required for virulence and/or pathogenicity, such as a type IV pili or a TonB-like protein. By "passaged phage" is meant a phage population which has been propagated by one or more periods of growth in cultured host cells. Typical hosts used in the present invention may be bacterial cells, particularly bacterial species of the family Xanthomonadaceae, which includes both *Xylella* and *Xanthomonas*. In some embodiments, strains of *X. fastidiosa* which may be useful in practicing this invention may include Temecula1 (ATCC 700964); Ann-1 (ATCC 700598); Dixon (ATCC 700965); XF53, XF54, and XF95 (Whitehorn et al., *Science*, 336: 351-352 (2012)); XF134, XF136, XF140, XF141, XF15-1, XF15-1-1, TM1 (Jones, et al., *Ann. Rev Phytopathol.*, 45:245-262 (2007)); and tonB1 (Summer et al., *J. Bacteriol.* 192:179-190 (2010)). Exemplary strains of *Xanthomonas*, which are susceptible to one or more of the disclosed bacteriophage isolates, and which may be useful for this invention include EC12, Pres-4, or Jal-4 and Xac isolates such as North 40, Ft. Basinger, and Block22, among others. Other Xanthomonad bacteria may also be utilized in view of their susceptibility to Xfas100 and/or Xfas300 bacteriophage.

As used herein, the term "isolation" is defined as separation and identification of an organism from a solution containing a mixed culture of organisms. Organisms able to be isolated can include viruses, bacteria, plant cells, or the like. Bacteriophage can be isolated as described herein and known in the art. In one embodiment, general laboratory methods for isolating bacteriophage may include but are not limited to growth in cultured cells, bacteriophage assay, double agar method, and plaque assay, among others. The present invention provides a method of isolating bacteriophage by a method involving overlaying at least a first sample comprising different strains of bacterial host cells together in order to isolate bacteriophage able to infect and propagate within both host cell types.

The invention also provides a method of propagating a virus (bacteriophage) virulent to *Xylella fastidiosa* and/or Xa. Methods of propagating bacteriophages are known in the art, and can encompass any method capable of producing quantities of bacteriophage sufficient for treating plant diseases. In one embodiment, propagating bacteriophage virulent to *X. fastidiosa* and/or Xac can comprise growing bacteriophage in *Xanthomonas* bacteria, allowing the bacteriophage to propagate, and isolating bacteriophage particles from the culture.

Bacteriophage virulent to *X. fastidiosa* may be prepared using a soft agar overlay method. High-titer phage plate lysates may be prepared, for instance, by harvesting an overlay plate of *X. fastidiosa* strain Temecula or *Xanthomonas* strain EC-12 exhibiting confluent lysis, followed by maceration and clarification by centrifugation. After being filter sterilized, the resulting lysates can be stored at 4° C. Subsequently, high-titer phage lysates may be purified by isopycnic CsCl centrifugation, and extracted phage solution are dialyzed. CsCl-purified bacteriophage having a titer of, for instance, $1 \times 10^{11}$ PFU/ml can be obtained.

A preferred ratio of bacteriophage in plant tissue filtrates (PTFs) for enrichment is, for instance, 1 ml of PTF to 20 ml of the surrogate host culture (actively growing culture of selected host), grown for 4 days for *X. fastidiosa* strain Temecula or for 4 hours for *Xanthomonas* strain EC-12.

The invention also provides a method of treating or reducing symptoms associated with *X. fastidiosa* and/or Xa pathovars in a plant or plants. Typical Pierce's Disease symptoms include leaves becoming slightly yellow or red along margins, respectively; eventually leaf margins may dry or die in its zones One embodiment of the contemplated methods involves administering, to a plant infected with *X. fastidiosa* and/or Xa, bacteriophage(s) virulent to *X. fastidiosa* and/or Xa in a manner that will result in treatment of the plant. Treatment of plants for infection may be done by spraying, misting, dusting, injection, or any other method known in the art. Methods for formulating compositions for such applications are also well known in the art. For example, *X. fastidiosa* infects the vascular tissues of plants, and thus the invention as described herein may comprise introducing via injection a purified population of bacteriophage particles virulent to *X. fastidiosa* to a plant infected with *X. fastidiosa* such that the bacteriophage is able to infect and lyse the *X. fastidiosa* cells thereby treating the plant infection. However, one skilled in the art will recognize that other methods may successfully be used, as well. Xa is a foliar pathogen and infects plant leaves, stems, and fruit naturally by rain splashing directly through leaf stomata, or by way of wounds produced during strong winds or by insects. Thus, in one embodiment, the present invention may comprise introducing by spraying a composition comprising a purified population of bacteriophage particles virulent to Xa to a plant infected with Xa.

As used herein, the terms "treatment," "treating," and "treat" are defined as acting upon a disease, disorder, or condition with an agent to reduce or ameliorate the physiologic effects of the disease, disorder, or condition and/or its symptoms. "Treatment," as used herein, covers any treatment of a disease in a host (e.g., a plant species, including those of agricultural interest, such as edible plants or those used to produce edible products, as well as ornamental plant species), and includes: (a) reducing the risk of occurrence of the disease in a plant, (b) impeding the development of the disease, and (c) relieving the disease, i.e., causing regression of the disease and/or relieving one or more disease symptoms. "Treatment" is also meant to encompass delivery of an inhibiting agent to provide an effect, even in the absence of a disease or condition. For example, "treatment" encompasses delivery of a disease or pathogen inhibiting agent that provides for enhanced or desirable effects in the plant (e.g., reduction of pathogen load, reduction of disease symptoms, etc.).

The invention also provides a plant disease biocontrol composition formulated for delivery to a plant, the composition comprising at least one carrier, and at least one bacteriophage that is virulent to *Xylella fastidiosa* and *Xanthomonas* species such as Xa.

The virulent bacteriophage to *Xylella fastidiosa* and/or *Xanthomonas* species such as Xa as an active ingredient in the composition of the present invention is also provided as one of bacteriophage selected from the group consisting of the Xfas100 phage type, such as Xfas101, Xfas102, Xfas103, Xfas104, Xfas105, Xfas106, Xfas107, Xfas108, Xfas109, and Xfas110, and/or the Xfas300 phage type, such as Xfas301, Xfas302, Xfas303, Xfas304, Xfas305, and Xfas306, wherein said phage type of the Xfas103, Xfas106, Xfas302, Xfas303, Xfas304, and Xfas306, which have been deposited under ATCC Accession Numbers PTA-13096, PTA-13095, PTA-13098, PTA-13099, PTA-13100, and PTA-13097, respectively. The virulent bacteriophage to *Xylella fastidiosa* and/or *Xanthomonas* species such as Xa as an active ingredient in the composition of the present invention is also provided as one of bacteriophage selected from the group consisting of the XfaMija or XfaMijo phage type, which have been deposited under ATCC Accession Numbers ATCC PTA-122743 and ATCC PTA-122742, respectively or variants thereof.

The virulent bacteriophage of the Xfas100 phage type as an active ingredient in the present invention displays at least one of the following characteristics: (a) the bacteriophage has an activity of the capable of lysing said *Xylella fastidiosa* and *Xanthomonas* bacteria, (b) the bacteriophage infects a cell by binding to a Type IV pilus, (c) the tailed bacteriophage exhibits long non-contractile tails with capsid ranging from 55-77 mm in diameter, a morphology typical of Siphoviridae family, (d) the genomic size of bacteriophage is about 55500 bp to 56200 bp and (e) the bacteriophage has an activity of preventing or reducing symptoms associated with Pierce's Disease in a plant or plants.

The virulent bacteriophage of the Xfas300 phage type as an active ingredient in the present invention has at least one of the characteristics, wherein said characteristics is; (a) the bacteriophage has an activity of the capable of lysing said *Xylella fastidiosa* and *Xanthomonas* bacteria; (b) the bacteriophage infects a cell by binding to a Type IV pilus; (c) the group of a tailed bacteriophage exhibits short non-contractile tails with capsid ranging from 58-68 mm in diameter, a morphology typical of Podoviridae family; (d) the genomic size of the bacteriophage is about 43300 bp to 44600 bp; and (e) the bacteriophage has an activity of preventing or reducing symptoms associated with Pierce's Disease in a plant or plants. Virulent bacteriophage as an active ingredient in compositions of the present invention further comprises at least one bacteriophage selected from the Xfas100 phage type and/or the Xfas300 phage type, wherein said Xfas100 phage type is Xfas103 and Xfas106 and/or said Xfas300 phage type is Xfas302, Xfas303, Xfas304, and Xfas306.

The virulent bacteriophage of the Xfas500 phage type (for example XfasMija and XfasMijo) as an active ingredient in the present invention has at least one of the characteristics: (a) the bacteriophage has an activity of the capable of lysing said *Xylella fastidiosa* and *Xanthomonas* bacteria; (b) the bacteriophage infects a cell by adsorbing to a Type IV pilus; (c) the group of a tailed bacteriophage exhibits contractile tails (ranging from 198-207 nm in length) with capsid (87-91 nm in diameter), a morphology typical of Myoviridae family; (d) the genomic size of the bacteriophage is about 190,000 bp to 230,000 bp; and (e) the bacteriophage has an activity of preventing or reducing symptoms associated with Pierce's Disease in a plant or plants. Virulent bacteriophage as an active ingredient in compositions of the present invention further comprises at least one bacteriophage selected from the Xfas500 phage type, wherein said Xfas500 phage type is Xfas501 (Mija) and Xfas502 (Mijo).

Bacteriophage virulent to *Xylella fastidiosa* and *Xanthomonas* species, such as Xa, used as an active ingredient in the composition of the present invention is also provided by a combination of phage, such as a cocktail of two, three, four, five, six, or more virulent bacteriophage isolates or types, which may be provided simultaneously or sequentially, including with a carrier. The term "carrier" refers to a diluent, adjuvant, surfactant, excipient, or vehicle with which the phage is administered. Such carriers can be sterile liquids, such as water and oils, including those of petroleum, animal, vegetable or synthetic origin, such as peanut oil, soybean oil, mineral oil, sesame oil and the like. Saline solutions, including phosphate solution such as sodium monohydrogen phosphate, potassium dihydrogen phosphate and aqueous dextrose and glycerol solutions can also be employed as liquid carriers, particularly for injectable solutions. Suitable excipients may include starch, glucose, lactose, sucrose, gelatin, malt, rice, flour, chalk, silica gel, sodium stearate, glycerol monostearate, talc, sodium chloride, dried skim milk, glycerol, propylene glycol, water, ethanol, and the like.

A plant disease biocontrol composition, if desired, may also contain minor amounts of wetting or emulsifying agents, or pH buffering agents.

Protective agents such as, but not limited to, casein based formulations, flour-based formulations, sucrose, Congo red, N-propyl-gallete, and lignin-based formulations, can be added to a plant disease biocontrol composition.

Phage concentration required for efficient disease control is not limited, but for example can be from $1\times10$-$1\times10^{12}$ PFU/ml, $1\times10^{4}$-$1\times10^{11}$ PFU/ml or $1\times10^{7}$-$1\times10^{10}$ PFU/ml.

Depending growing age of tree, the thickness of the stem, the size of the root, the dosage is adjusted appropriately. A plant disease biocontrol composition can be a dry product, a substantially dry product, a liquid product, or a substantially liquid product. In some embodiments, a dry or substantially dry product can be reconstituted in a liquid (e.g., water, etc.), and then applied to a plant. In other embodiments, such a composition can be applied in dry or substantially dry form, where liquid that is already present on the plant, is concurrently applied to the plant, or that subsequently appears on the plant (e.g., by application, condensation, etc.) facilitates exposure of the bacteriophage to target bacteria. In another embodiment, such a composition can be applied by spray, mist, or dust on the plant.

A plant disease biocontrol composition can take the form of a solution, a suspension, an emulsion, a powder, a tablet, and the like.

The timing of application of a plant disease biocontrol composition is not limited, but may for instance be daily, weekly, or twice-weekly, monthly, bimonthly, or quarterly.

The present invention also provides an isolated bacteriophage that is virulent to *Xylella fastidiosa* and *Xanthomonas* species, such as Xa and pathovars thereof.

The invention also provides an isolated bacteriophage as one of bacteriophage selected from the group consisting of the Xfas100 phage type, such as Xfas101-Xfas110, and/or the Xfas300 phage type, such as Xfas301-Xfas306, and wherein Xfas103, Xfas106, Xfas302, Xfas303, Xfas304, and Xfas306, which have been deposited under ATCC Accession Numbers PTA-13096, PTA-13095, PTA-13098, PTA-13099, PTA-13100, and PTA-13097, respectively. The invention further provides an isolated bacteriophage as one of bacteriophage selected from the group consisting of XfaMija or XfaMijo phage type, which have been deposited under ATCC Accession Numbers ATCC PTA-122743 and ATCC PTA-122742, respectively or variants thereof.

Such a bacteriophage can be detected by confirming the capability of forming plaques on *Xylella fastidiosa* and/or *Xanthomonas* species.

DEPOSIT INFORMATION

A deposit of representative bacteriophage of each of strains Xfas103, Xfas106, Xfas302, Xfas303, Xfas304, and Xfas306, and a deposit of representative bacteria of *X. axonopodis* EC-12, which are disclosed herein above and referenced in the claims, was made with the ATCC, located at P. O. Box 1549, Manassas, Va. 20108, USA. The date of deposit for the accessions was Jul. 24, 2012 and the accession numbers for the deposited strains are PTA-13096, PTA-13095, PTA-13098, PTA-13099, PTA13100, PTA13097, and PTA-13101, respectively. All restrictions upon the deposit will be removed upon the granting of a patent, and the deposit is intended to meet all of the requirements of 37 C.F.R. § 0.1.801-1.809. The deposit will be maintained in the depository for a period of 30 years, or 5 years after the last request, or for the effective life of the patent, whichever is longer, and will be replaced if necessary during that period.

A deposit of representative bacteriophage of each of strains XfaMija and XfaMijo, which are disclosed herein above and referenced in the claims, was made with the ATCC, located at P. O. Box 1549, Manassas, Va. 20108, USA. The date of deposit for the accessions was Jan. 13, 2016, and the accession numbers for the deposited strains are ATCC PTA-122743 and ATCC PTA-122742, respectively. All restrictions upon the deposit will be removed upon the granting of a patent, and the deposit is intended to meet all of the requirements of 37 C.F.R. § 1.801-1.809. The deposit will be maintained in the depository for a period of 30 years, or 5 years after the last request, or for the effective life of the patent, whichever is longer, and will be replaced if necessary during that period.

EXAMPLES

The following examples are included to demonstrate preferred embodiments of the invention. It should be appreciated by those of skill in the art that the techniques disclosed in the examples which follow represent techniques discovered by the inventor to function well in the practice of the invention, and thus can be considered to constitute preferred modes for its practice. However, those of skill in the art should, in light of the present disclosure, appreciate that many changes can be made in the specific embodiments that are disclosed and still obtain a like or similar result without departing from the spirit and scope of the invention.

Example 1

Media, Culture Conditions and Bacterial Strains

This example describes the isolation, propagation, and the morphological and genomic characterization of bacteriophage virulent to *X. fastidiosa* and *Xanthomonas* species. The medium used in this study differs from standard medium used to grow *X. fastidiosa*, which allows rapid growth but affects the ability of the bacteriophage to infect. PW broth medium as modified by Sherald et al. (*Plant Disease* 67:849-852, 1983) designated PW-M, was used for growth of *X. fastidiosa* isolates, except that the final bovine serum albumin content was 0.3% as modified by Hill and Purcell (Phytopathology 85(12):1368-1372, 1995). For solid medium (PW-MA) and soft agar, the PW-M broth was amended with 15 g/l and 7.5 g/l, respectively, of Plant Cell Culture Tested agar (Sigma). The complex medium TN broth (TNB) was used for routine maintenance of non-*X. fastidiosa* cultures. Solid medium (TNA) was identical, with the exception that it lacked $KNO_3$ and was supplemented with 20 g/L agar. For soft agar overlays, TN medium was amended with 7.5 g/L of agar (TNSA). For plating of plant extracts to obtain total bacterial counts, TNA medium was amended with cycloheximide (40 µg/ml; TNAC). All cultures were grown at 28° C. and liquid cultures were monitored at $\lambda$=600 nm using Nephelo flasks. California *X. fastidiosa* isolates included in the study were Temecula (XF15), which is representative of *X. fastidiosa* subspecies *fastidiosa*, Ann1 (XF108), representative of *X. fastidiosa* subspecies sandyi, and Dixon (XF102), representative of *X. fastidiosa* subspecies multiplex (Hendson et al., Applied and Environmental Microbiology 67(2):895-903, 2001). Texas *X. fastidiosa* isolates included one each from *Platanus occidentalis* (XF1), *Helianthus annuus* (XF5), *Iva annua* (XF18), *Ambrosia psilostachya* (XF23), *Ratibida columnifera* (XF37), *Vitis aestivalis* (XF39), *Vitis mustangensis* (XF41), three isolates from *Ambrosia trifida* var. *texana* (XF16, 40, and 43), two from *Nerium oleander* (XF93 and 95), and 15 from *Vitis vinifera* (XF48, 50, 52, 53-54, 56, 58, 59, 60, 66, 67, 70, 71, 76, and 78). All isolates were single-colony purified by the streak isolation method, and stored at −80° C. after amending PW-M broth cultures to a final concentration of 20% glycerol (v/v). *X. fastidiosa* isolates were confirmed at the species and subspecies level using polymerase chain reaction (PCR) analysis as previously described (Hernandez-Martinez et al., *Plant Disease* 90(11):1382-1388, 2006). The MIDI Sherlock® Microbial Identification System that analyzes fatty acid methyl esters by gas chromatography (GC-FAME) was used to identify *Xanthomonas* species.

Example 2

Processing of Plant Samples and Isolation of Bacteria

Plant samples of *Vitis vinifera*, *V. mustangensis*, and weeds were obtained from vineyards in Brazos County and Washington County, Tex. Rice (*Oryza sativa*) plant tissue and weeds from rice fields were obtained from Jefferson County and Wharton County, Tex. Rice seed samples were obtained from the Texas AgriLife Research Center in Beaumont, Tex. Samples from rose plants (Rosa spp.; Knock Out) and jalapeno (TAM-mild; *Capsicum annuum*) were obtained in Brazos County, Tex. To obtain plant extracts, 10 g of plant tissue were ground using a mortar and pestle in 50 ml bacteriophage buffer (P-buffer; 50 mM Tris-HCl pH 7.5, 100 mM NaCl, 8 mM $MgSO_4$), vortexed, and strained through a double-layer of cheesecloth to remove large particles. The extract was then dilution plated to both PW-M and TNAC for the isolation of *X. fastidiosa* and non-*X. fastidiosa* bacteria, respectively, and incubated at 28° C. Plates were evaluated for growth daily for up to 10 days.

Example 3

Isolation, Purification and Titration of Bacteriophage from Plant Samples

To obtain plant tissue filtrates (PTFs) the clarified plant extract was centrifuged (10,000×g, 10 min at 4° C.), twice and the tissue extract were filtered through a 0.22 μm filter (Supor, Pall Life Sciences). The presence of bacteriophage in PTFs was directly determined by spotting 10 μl of a 10-fold dilution series on overlays of a panel of *X. fastidiosa* and *Xanthomonas* species hosts and observing for zone or plaque formation after lawn development (6-7 days for *X. fastidiosa* isolates and 18 h for *Xanthomonas* species isolates). Alternatively, bacteriophage were enriched from the PTFs by adding 1 ml of each filtrate to 20 ml of an actively growing culture of an *X. fastidiosa* isolate (4 day culture; $A_{600}$=0.30) or an $A_{600}$=0.25 (4 h) culture of a *Xanthomonas* species host. After 3-4 days or 24 h of growth for the *X. fastidiosa* or *Xanthomonas* species enrichment, respectively, the cultures were centrifuged (10,000×g, 10 min at 4° C.) and filter sterilized (0.22-μm filter). To determine the presence of bacteriophage in the enriched supernatants, 10 μl of a 10-fold dilution series was spotted on overlays of a panel of *X. fastidiosa* and *Xanthomonas* species hosts and observed for zone or plaque formation. Five-day-old cultures of *X. fastidiosa* isolates grown on PW-MA were used to make host suspensions in PW-M broth ($A_{600}$=0.5), whereas 18-h cultures of *Xanthomonas* species isolates grown on medium TNA were used to make suspensions in TN broth ($A_{600}$=0.5), and used to make overlays. Soft agar overlays used to survey bacterial supernatants for bacteriophage activity were made by mixing 100 μl of the bacterial suspension with 7 ml of molten PW-M or TN soft agar, pouring the mixture on PW-MA or TNA plates, and allowing it to solidify and dry. Spotted overlays showing either plaques or cleared zones formation were further investigated by plating as above, except that the PTF dilutions were directly mixed with individual host indicator suspensions before overlaying. Individual plaques formed on either *X. fastidiosa* or *Xanthomonas* species host overlays were excised, suspended in P-buffer and titered. This procedure was repeated three times to obtain a single plaque isolate. High-titer lysates ($1 \times 10^{10}$ PFU/ml) were prepared by harvesting overlays of plates exhibiting confluent lysis with 5 ml of P-buffer, macerating the soft agar overlay, clearing the lysate by centrifugation (10,000×g, 15 min at 4° C.) and filter sterilizing through a 0.22-μm filter. Lysates were stored at 4° C.

Plant extracts were plated to both PW-M and to TNAC for selection of *X. fastidiosa* and to obtain total bacterial counts, respectively. Plant extracts from all plants assayed did not yield any evidence of *X. fastidiosa* isolates. However, the non-selective plating did yield a large variety of bacterial colony types. Representative single colonies of yellow pigmented bacteria were picked from plates and streak purified to obtain stocks. The stocks were used to make overlays to which the PTFs where spotted to observe for zone or plaque formation. Bacterial isolates Presidio-4, Jal-4, and EC-12 obtained from extracts of rice seed, jalapeno leaves, and rice tissue, respectively, were all identified as *Xanthomonas* species using fatty acid methyl ester analysis by gas chromatography (GC-FAME) and were used as hosts for evaluation of PTFs. Other Xa strains may be utilized as well, in view of the virulence of one or more disclosed bacteriophage on such strains.

Dilutions of several PTFs produced plaques on isolates XF15, XF53, XF54, XF95, after 5 to 6 days of incubation, indicating that bacteriophage able to form plaques on these hosts were present in the plant tissue. Initial titers observed from extracts ranged from $5 \times 10^1$ to $7 \times 10^5$ PFU/gram of tissue. Since all PTFs showed the same pattern of production on XF15, XF53, XF54, and XF95, strain XF15 was used as the host for plaque purification and production. The high titer found in this non-enriched PTF indicates that natural bacterial hosts associated with the plant tissue can serve as host for bacteriophage, which can produce plaques on overlays of *X. fastidiosa*. Serial plating of the PTF yielded individual plaques that were uniform in size. Individual plaques were excised and plaque-purified three times using XF15 as the host to obtain clonal isolates. A culture dish of bacteriophage Xfas302 purified and increased using *Xylella fastidiosa* host strain Temecula ($1 \times 10^9$ PFU (Plaque Forming Units)/ml)) and titered on *Xanthomonas* species isolate Pres-4 and EC-12 (both of $5 \times 10^7$ CFU (Colony Forming Units)/ml), indicating that Bacteriophage Xfas302 propagated on *X. fastidiosa* strain XF15 (Jones et al., 2007) or *X. fastidiosa* Temecula strain (ATCC 700964) was able to form plaques on *Xanthomonas* species strain Pres-4 and EC12 (EC12 deposited under ATCC Accession Number PTA-13101) providing evidence that bacteriophage propagated on *X. fastidiosa* can adsorb, replicate, and form plaques on *Xanthomonas* strains. Host range studies presented below further substantiate these results.

Figure 2:
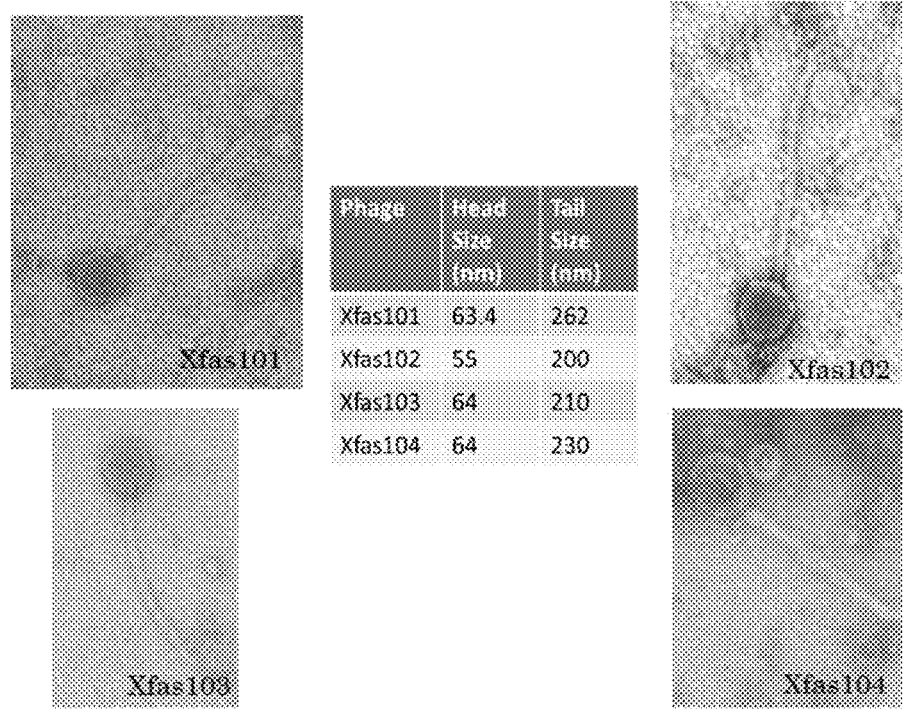
FIG. 2: Shows a TEM image of phages Xfas101, Xfas102, Xfas103, and Xfas104, with morphology and size characteristic of Siphoviridae.

Phages Xfas101-Xfas105 all produced small clear plaques on XF15 lawns, whereas phages Xfas301-Xfas305, produced large clear plaques on the same host. TEM images of Xfas302-Xfas305 and Xfas101-Xfas104 are shown in FIG. 1 and FIG. 2, respectively. High titer lysates produced using XF15 were used to obtain CsCl-purified preparations of each bacteriophage, which were used to conduct transmission electron microscopy (TEM) studies. Phages Xfas101-Xfas105 all exhibited long non-contractile tails with capsids ranging from 55-64 nm in diameter, and thus were determined to belong to the Siphoviridae family. Xfas301-Xfas305 all exhibited short non-contractile tails with capsids ranging from 58-65 nm in diameter, morphology typical of Podoviridae.

Example 4

Enrichment of Bacteriophage from Wastewater

Clarified wastewater samples were obtained from treatment facilities in the Bryan, Tex. area. Samples were obtained from the Still Creek, Carter Creek, Turkey Creek, and Burton Creek facilities (Brazos County, Tex.). Samples were centrifuged (10,000×g, 10 min at 4° C.) twice and the tissue extracts were filtered through a 0.22-μm filter. Phages were enriched by adding 1 ml of each filtrate to 20 ml of an actively growing culture of selected hosts as described above. After 72 and 24 h of growth for the *X. fastidiosa* or

*Xanthomonas* species enrichment, respectively, the cultures were centrifuged and filter sterilized. The enriched filtrates were spotted to titer on overlays as described above.

Figure 3:
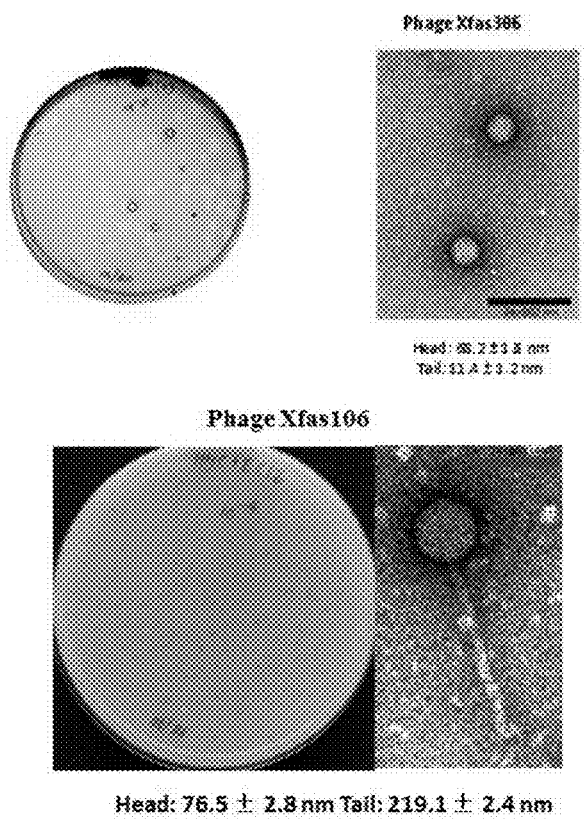
FIG. 3: Shows Podoviridae and Siphoviridae bacteriophages of *X. fastidiosa* isolated from wastewater, able to form plaques on XF15 and EC-12.

Phages Xfas106-109 and Xfas306 were isolated from individually enriched samples obtained from the four wastewater treatment plants using host EC-12 as the host. TEM studies of purified bacteriophage concentrates morphologically identified bacteriophage Xfas306 as Podoviridae by a short non-contractile tail with a capsid of 68 nm in diameter (FIG. 3), whereas phages Xfas106-109 isolated exhibited long non-contractile tails with capsids of ~77 nm in diameter (FIG. 3) characteristic of Siphoviridae. Bacteriophage Xfas306 produced large clear plaques on both hosts EC-12 and XF15, whereas phages Xfas106-109 produced small clear plaques on the same hosts (FIG. 3). Therefore, the method used in this experiment enabled isolation of *X. fastidiosa* bacteriophage from environmental samples.

Example 5

CsCl-Purification

Filter-sterilized bacteriophage suspensions were concentrated by centrifugation (90,000×g for 2.5 h at 5° C.) using a Type 60Ti rotor in a Beckman L8-70M ultracentrifuge. Pellets were resuspended in P-buffer and treated with DNase I and RNase A (Sigma) at a final concentration of 1 µg/ml at 25° C. for 2 h. CsCl was added to the bacteriophage suspension at a final concentration of 0.75 g/ml and centrifuged (300,000×g for 18 h at 5° C.) in a VTi 65.2 rotor. The visible bacteriophage band was extracted using an 18-gauge syringe needle and dialyzed against P-buffer amended to 1 M NaCl overnight at 4° C. and twice for 4 h at 25° C. against P-buffer to obtain a suspension of $1 \times 10^{11}$ PFU/ml. The CsCl-purified bacteriophage was stored at 4° C.

Example 6

Transmission Electron Microscopy

Electron microscopy of CsCl-purified bacteriophage ($1 \times 10^{11}$ PFU/ml) was performed by diluting with P-buffer and applying 5 µl onto a freshly glow-discharged formvar-carbon coated grid for 1 min. Grids were then washed briefly on de-ionized water drops and stained with 2% (w/v) aqueous uranyl acetate. Specimens were observed on a JEOL 1200EX transmission electron microscope operating at an acceleration voltage of 100 KV.

Example 7

Efficiency of Plating and Host Range

The efficiency of plating (EOP) was obtained by calculating the ratio of the bacteriophage plaque titer obtained with the heterologous (non-propagating) host to that obtained on the homologous (propagating) host. Bacteriophage stocks were titered on either *X. fastidiosa* or *Xanthomonas* species host using the appropriate medium by mixing 100 µl bacteriophage stock dilutions with individual host indicator suspensions ($A_{600}$=0.5) in soft agar (7 ml) before overlaying on solid medium.

Studies comparing the EOP of Xfas phages are shown in Table 1. The EOP for phages isolated from plant samples propagated using *Xanthomonas* species strain EC-12 and then titered using *X. fastidiosa* strain XF15 as the host, ranged from $1 \times 10^{-1}$ to $1 \times 10^{-3}$, with similar results seen when bacteriophage propagated using strain XF15 were then titered using EC-12 as the host. Similar studies with phages isolated from wastewater filtrates and propagated on strain EC-12 exhibited EOPs ranging from $1 \times 10^{-1}$ to $5 \times 10^{-1}$. EOPs of $1 \times 10^{-1}$ to $3 \times 10^{-1}$ were obtained when phages Xfas106-109 were propagated on strain XF15 and plated on host EC-12, indicating that, while DNA restriction and modification barriers may exist, phages propagated in fast-growing strain EC-12, in one day, can adsorb, replicate and form plaques on *X. fastidiosa*, a process which can take up to 10 days on *X. fastidiosa* alone.

TABLE 1

Efficiency of Plating for Xfas Phages Propagated on *X. fastidiosa* or *Xanthomonas* species hosts

| Bacteriophage Designation | Propagated → Plated XF15 → EC-12 | Propagated → Plated EC-12 → XF15 |
|---|---|---|
| Xfas101 | 3.00E−02 | 5.00E−02 |
| Xfas102 | 3.33E−02 | 5.00E−02 |
| Xfas103 | 1.00E−02 | 3.33E−03 |
| Xfas104 | 4.00E−01 | 5.00E−02 |
| Xfas105 | 1.00E−01 | 1.00E−01 |
| Xfas106 | 1.00E−01 | 2.50E−01 |
| Xfas301 | 5.00E−03 | 1.00E−02 |
| Xfas302 | 1.00E−01 | 5.00E−04 |
| Xfas303 | 2.67E−03 | 1.00E−03 |
| Xfas304 | 1.00E−02 | 5.00E−03 |
| Xfas305 | 1.00E−02 | 5.00E−02 |
| Xfas306 | 3.33E−01 | 3.00E−01 |

Lawns of the host were made by overlaying plates of the appropriate medium, PW-M (for XF15) or TNA (for EC-12) with the homologous soft agar seed with individual host. High titer lysates ($1 \times 10^9$ PFU/ml) of individual bacteriophage preparations were then spot titered on to the individual lawns by spotting 10 µl of a 10-fold dilution series on overlays of the *X. fastidiosa* or *Xanthomonas* species hosts. After incubation of plates at 28° C. for the appropriate times, (24 h for EC-12 or 5-7 days for XF15) plates were evaluated for zones and plaque formation.

Initial host range studies shown in Table 2 indicate that all phages which were able to form plaques on *X. fastidiosa* host XF15 also formed plaques on host EC-12, whereas hosts Jal-4 and Pres 4 exhibited insensitivity to most of the siphophages. Reasons for resistance range from lack of adsorption or other post adsorption mechanism such as bacteriophage-genome uptake blocks, superinfection immunity, restriction modification, and clustered regularly interspaced short palindromic repeats (CRISPRs).

TABLE 2

Host Range of Xfas phages*

| Phages | Temecula (XF15) | Hosts EC-12 | Jal 4-1 | Pres 4 | Ann1 (XF108) | Dixon (XF102) |
|---|---|---|---|---|---|---|
| Xfas101 | S | S | S | R | S | S |
| Xfas102 | S | S | S | R | S | S |
| Xfas103 | S | S | R | R | S | S |
| Xfas104 | S | S | R | R | S | S |
| Xfas105 | S | S | S | R | S | S |

TABLE 2-continued

Host Range of Xfas phages*

| Phages | Hosts | | | | | |
|---|---|---|---|---|---|---|
| | Temecula (XF15) | Hosts EC-12 | Jal 4-1 | Pres 4 | Ann1 (XF108) | Dixon (XF102) |
| Xfas106 | S | S | R | R | S | S |
| Xfas107 | S | S | R | R | S | S |
| Xfas108 | S | S | R | R | S | S |
| Xfas109 | S | S | R | R | S | S |
| Xfas301 | S | S | R | R | S | S |
| Xfas302 | S | S | S | S | S | S |
| Xfas303 | S | S | S | S | S | S |
| Xfas304 | S | S | S | S | S | S |
| Xfas305 | S | S | S | S | S | S |
| Xfas306 | S | S | R | R | S | S |

*EC-12 host for propagation of phage used in testing.
S = ability to form clear plaques on indicated host;
R = not able to form plaques on indicated host.

Example 8

Preliminary Identification of Xfas Adsorption Sites

Based on the observation that *X. fastidiosa* phages obtained or enriched from either plant tissue or wastewater samples formed plaques on *X. fastidiosa* it was of interest to determine if cell surface components could serve as adsorption sites. Known adsorption sites for phages include surface proteins such as OmpA and OmpF, the core and O-chain of the bacterial LPS in Gram-negative bacteria, sex and type IV pili, and flagella. The wild type and a derivative mutant with a deletion of the pilA, resulting in a derivative devoid of type IV pili, were evaluated as hosts for Xfas phages. All bacteriophages tested formed plaques on the XF15 wild type strain but not the XF15ΔpilA mutant. Results suggested that type IV pili may be a primary site of attachment for Xfas phages.

Based on results obtained with XF15-ΔpilA it was of interest to determine if pilA deletion mutants of *Xanthomonas* species strain EC-12 would become insensitive to Xfas phages Xfas103, Xfas106 Xfas302, Xfas303 Xfas304 and Xfas306. Strain EC-12Δ pilA was insensitive to the phages in plate titer assays, and in an adsorption experiment with phage Xfas303 no adsorption to the host was observed. The EC-12ΔpilA-complemented in trans for the pilA was sensitive to all tested phages. This further demonstrated that type IV pili are a primary site of attachment for phages as observed for *X. fastidiosa.*

Example 9

Bacteriophage DNA Isolation and Genome Sequencing

Bacteriophage genomic DNA was prepared from 10-20 ml of filter-sterilized, high-titer (>$1\times10^9$ PFU/ml) CsCl-purified bacteriophage lysates using a modified form of the Promega Wizard DNA clean-up kit (Promega). Briefly, 10-20 ml of bacteriophage lysate was digested with 10 μg/ml each of DNase I and RNase A (Sigma) at 37° C. for 30 min and precipitated in the presence of 10% (w/v) polyethylene glycol 8000 and 1 M NaCl for 16-20 h at 4° C. The precipitate was centrifuged at 10,000×g, 4° C. for 10 min and the pellet resuspended in 0.5 ml of P-buffer. One ml of the DNA purification resin supplied with the Wizard kit was added to the resuspended bacteriophage, loaded onto a minicolumn and washed with 2 ml of 80% (v/v) isopropanol. DNA was eluted from the resin by addition of 100 μl of water pre-heated to 80° C. followed immediately by centrifugation of the minicolumn. DNA integrity was verified by running on a 0.8% agarose gel and staining with ethidium bromide and DNA was quantified by band densitometry. Bacteriophage genome size was estimated by pulsed-field gel electrophoresis (PFGE) analysis of genomic DNA on a 1% agarose gel (Pulsed-Field agarose, BioRad) and comparison to a size marker (MidRange Marker I, NEB).

Phages were sequenced using "454" pyrosequencing (Roche/454 Life Sciences, Branford, Conn., USA, at Emory GRA Genomics Core: Emory Univ., Atlanta, Ga.). Bacteriophage genomic DNA was prepared from bacteriophage isolates as described above and mixed in equimolar amounts to a final concentration of ca. 100 ng/μl. The pooled DNA was sheared, ligated with a multiplex identifier (MID) tag specific for each of the four pools and sequenced by pyrosequencing using a full-plate reaction on a Roche FLX Titanium sequencer according to the manufacturer's protocols. The pooled bacteriophage DNA was present in two sequencing reactions. The reaction contained genomic DNA representing 39 genomic elements totaling ca. 3,331 kb of genomic sequence, and the sequencing run yielded 987,815 reads with an average length of 405 bp, providing a total of 120-fold coverage for the entire pool. The trimmed FLX Titanium flowgram outputs corresponding to each of the four pools were assembled individually using the Newbler assembler version 2.5.3 (454 Life Sciences) by adjusting settings to include only reads containing a single MID identifier per assembly. The identity of individual contigs was determined by PCR using primers generated against contig sequences and individual bacteriophage genomic DNA preparations as template; the generation of the expected size product from a bacteriophage DNA template was used to match individual phages to their contigs. Sequencher (Gene Codes Corporation) was used for sequence assembly and editing. Protein coding regions were predicted using Genemark (opal.biology.gatech.edu/GeneMark/gmhmm2_prok.cgi) and manually edited in Artemis (www.sanger.ac.uk/Software/Artemis/) (Lukashin et al., *Nucleic Acids Research* 26(4):1107-1115, 1998; Rutherford et al., *Bioinformatics* 16(10):944-945, 2000). DotPlots were generated using DOTTER (Brodie et al., *Bioinformatics* 20(2): 279-281, 2004). Predicted proteins were compared to proteins in the GenBank database using BLAST (www.ncbi.nlm.nih.gov/blast/Blast.cgi). Conserved domains, lipoprotein processing signals and transmembrane domains (TMDs) were identified with InterProScan (www.ebi.ac.uk/Tools/webservices/services/interproscan), LipoP (www.cbs.dtu.dk/services/LipoP/), and TMHMM (www.cbs.dtu.dk/services/TMHMM/), respectively.

TABLE 3

TABLE 3. Genomic size of Xfas Phages.

| Family of Morphology | Phage | SEQ ID | ATCC Accession Numbers | Genomic Size (bp) | Identity (bp) | Dice score (% identity over entire genome of Xfas103) |
|---|---|---|---|---|---|---|
| Xfas100 Siphoviridae Types | Xfas101 | 11 | | 56,132 | 56,144 | 100.01 |
| | Xfas102 | 12 | | 56,132 | 56,144 | 100.01 |
| | Xfas103 | 13 | PTA-13096 | 56,147 | 56,147 | 100.00 |
| | Xfas104 | 14 | | 56,144 | 56,144 | 100.00 |
| | Xfas105 | 15 | | 56,144 | 56,144 | 100.00 |
| | Xfas106 | 16 | PTA-13095 | 55,601 | 31,026 | 55.53 |
| | Xfas107 | 17 | | | | |
| | Xfas110 | 18 | | 56,134 | 56,144 | 100.01 |
| | | | | | | Dice score (% identity over entire genome of Xfas303) |
| Xfas300 Podoviridae Types | Xfas301 | 19 | | 44,443 | 33,254 | 75.25 |
| | Xfas302 | 20 | PTA-13098 | 44,521 | 33,347 | 75.39 |
| | Xfas303 | 21 | PTA13099 | 43,940 | 43,940 | 100.00 |
| | Xfas304 | 22 | PTA-13100 | 43,869 | 1,933 | 4.40 |
| | Xfas305 | 23 | | 43,324 | 43,940 | 100.71 |
| | Xfas306 | 24 | PTA-13097 | 43,745 | 32,886 | 75.01 |

Dice Score = ((2 × identity)/(Sequence length of both phages)) × 100

Example 10

Genomic Analysis of Xfas Phages and Description of the Xfas100 and Xfas300 Phage Types The phages isolated for their ability to attack *Xanthomonas* EC-12 and *X. fastidiosa* and subspecies that all require the type IV pili for infection and are all virulent, in that no lysogenic colonies can be isolated from infections and no genes associated with temperate life style (repressor, integrase) are found in the genome sequences. The phages can be further classified in two phage types, as defined by Casjens et al. (*Research in Microbiology*, 159:340-348, 2008).

Figure 4:
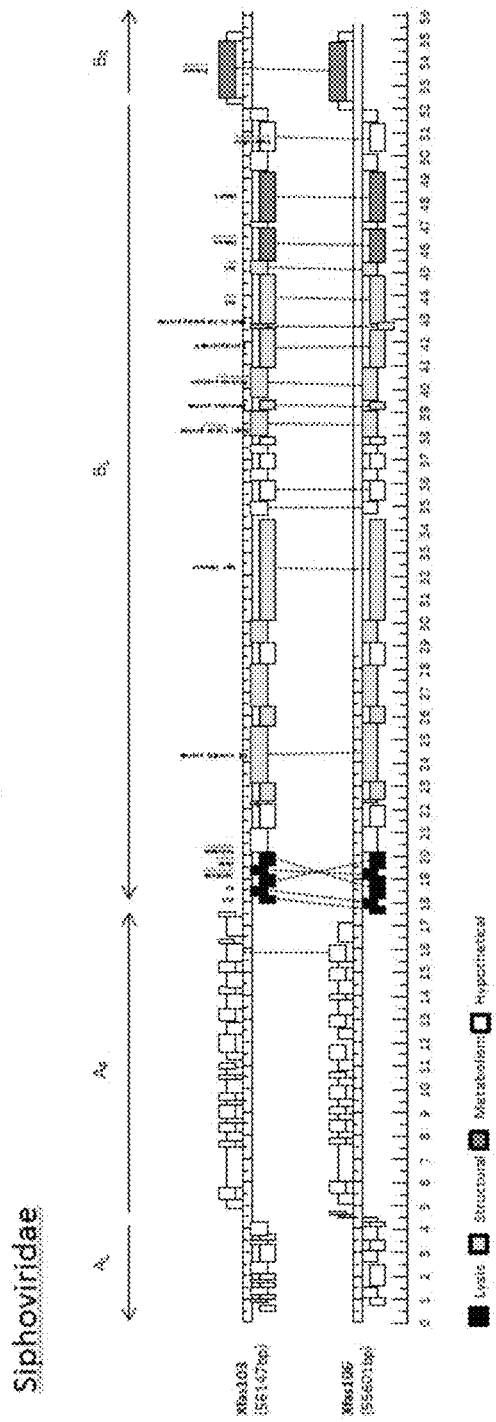
FIG. 4: Shows a genomic map of Siphoviridae Xfas103 and Xfas106.

(1) Xfas100 phage type: The Xfas100 phage type is comprised of virulent Siphophages (ICTV Siphoviridae) of *Xanthomonas* and *Xylella*, the prototypes of which are the phages Xfas101, Xfas102, Xfas103, Xfas104, Xfas105, Xfas106, Xfas107, Xfas108, Xfas109, and Xfas110 (Table 12) and further examples of which are listed in Table 3 as any phage designated "Xfas1nn," where n is any number (referred to as the Xfas100 series). This flexible nomenclature system is necessary because it is anticipated that further variants of the Xfas1nn phage type will be isolated. Xfas100-type phages are siphophages, are virulent in lifestyle, and require the type IV pili for infection of *Xylella* and *Xanthomonas* species. Xfas100-type phages have icosahedral capsid heads measuring approximately 55-77 nm in diameter and flexible tails of approximately 200-262 nm in length; both dimensional values are as determined within the standard precision of negative-stain electron microscopy (see FIGS. 2 and 3). The Xfas100 series viral DNA has cohesive (cos) ends characterized by single-stranded DNA overhangs (Casjens, et al., *Methods Mol Biol* 502:91-111, 2009), which is important for phages to be used in antibacterial applications because cos DNA packaging avoids the generation of generalized transducing particles that would potentiate the transfer of pathogenesis determinants. The Xfas100 genome has a characteristic overall organization (see FIG. 4) with the genes arrayed in two divergent gene clusters, $A_L$ and $A_R$ and $B_L$ and $B_R$. The Xfas100 phage type is further distinguished by the fact that the essential structural and lysis genes of the phage are grouped in rightward gene cluster $B_L$. The Xfas100 series phage type is also distinguished by encoding its own single-molecule DNA polymerase (Xfas103gp7/and Xfas106gp66), primase (Xfas103gp76 and Xfas106gp7/) and helicase (Xfas103gp69 and Xfas106gp64).

Figure 5:
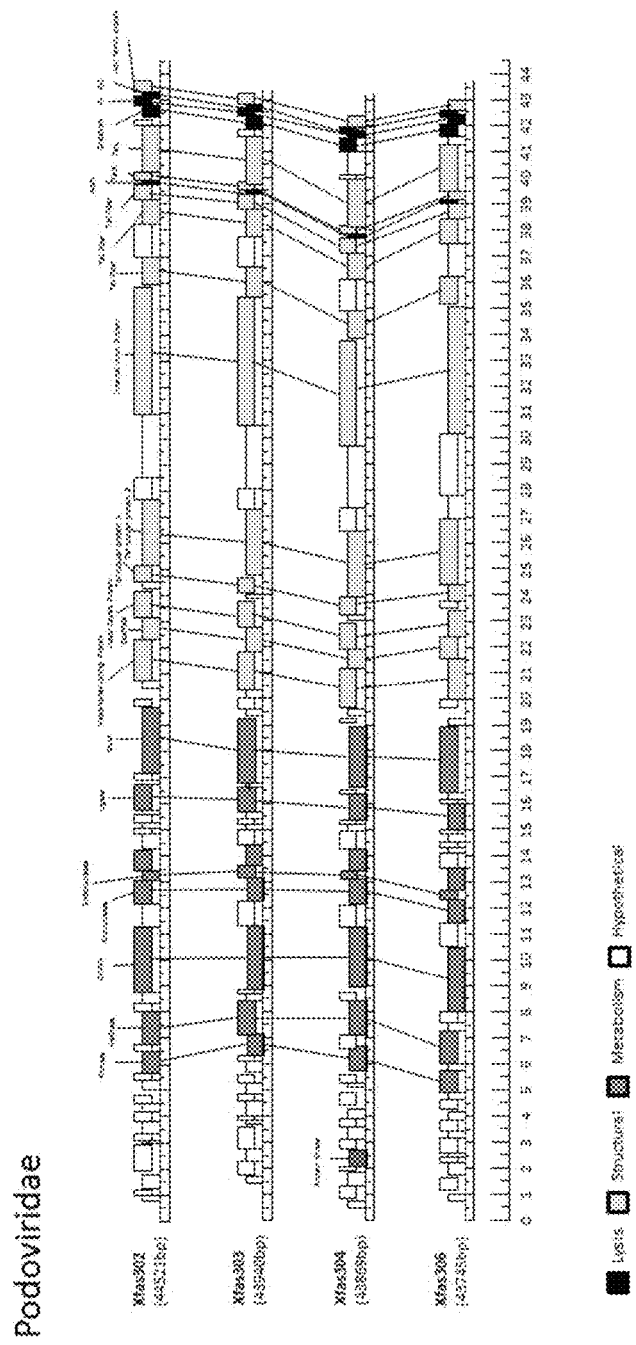
FIG. 5: Shows a genomic map of Podoviridae Xfas302, Xfas303, Xfas304, and Xfas306.
Figure 6:
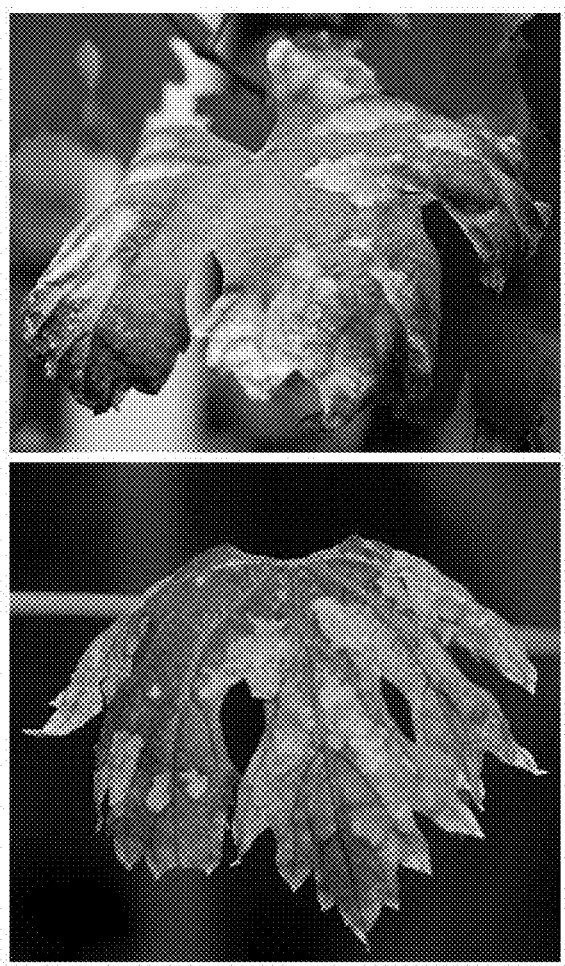
FIG. 6: Shows a grapevine plant exhibiting symptoms of Pierce's Disease 8 weeks after inoculation with strain XF54 and not challenged with bacteriophage.

(2) Xfas300 phage type: The Xfas300 phage type is comprised of virulent podophages (ICTV Podoviridae) of *Xanthomonas* and *Xylella*, the prototypes of which are the phages Xfas301, Xfas302, Xfas303, Xfas304, Xfas305, and Xfas306, and further examples of which are listed in Table 3, and refers to any phage with the designation "Xfas3nn" where n is any number (referred as Xfas300 series). This flexible nomenclature system is necessary because it is anticipated that further variants of the Xfas300 phage type will be isolated. Xfas300-type phages have icosahedral capsid heads measuring approximately 58-68 nm in diameter; this dimensional value is as determined within the standard precision of negative-stain electron microscopy (see FIGS. 1 and 3). The Xfas302-306 genome encodes a single-subunit RNA polymerase located adjacent to the structural protein region. The Xfas300 series genome has a characteristic overall organization (see FIG. 5) with the genes arrayed on one strand, including the replication, structural and lysis genes of the phage. The Xfas300 phage type is also distinguished by encoding its own single-molecule DNA polymerase (Xfas302gp18, Xfas303gp17, Xfas304gp17 and Xfas306gp17), single-subunit RNA polymerase (Xfas302gp31, Xfas303gp28, Xfas304gp27 and Xfas306gp30, respectively and helicase (Xfas302gp15, Xfas303gp14, Xfas304gp15 and Xfas306gp14 (see FIG. 5 for schematic of phage genome).

Example 11

Movement, Challenged and Protection Studies in Grapevines Using Bacteriophage Xfas304

Bacteriophage Xfas304, is a member of the family Podoviridae, isolated from environmental samples that has a host range that includes both *X. fastidiosa* and *Xanthomonas* species. In the studies presented here, the movement and persistence of Xfas304 was determined in grapevines in the absence of a sensitive host, in order to determine whether treatment of a plant with bacteriophage may prevent subsequent infection by *X. fastidiosa*. Additionally, grapevines that were first inoculated with *X. fastidiosa* were then challenged 4 weeks post-pathogen-inoculation with bacteriophage Xfas304, to determine if the bacteriophage could control the development of Pierce's Disease therapeutically.

For the preventative studies, grapevines were inoculated with 40 μl of a bacteriophage Xfas304 suspension ($1\times10^{10}$ PFU/ml) and then challenged 4 weeks post-bacteriophage-inoculation with *X. fastidiosa*. Bacterial *X. fastidiosa* suspensions used for inoculation were adjusted spectrophotometrically ($A_{600}$=0.4; $1\times10^9$ CFU/ml). Individual cordons were inoculated between the second and third node on opposite sites (two points/cordon) with 40 μl of the bacterial suspension using the needle inoculation technique as described by Hopkins (*Plant Dis.* 89:1348-1352, 2005). Control vines were mock inoculated with phosphate buffer at the same point of inoculation of the above.

The results indicated that bacteriophage Xfas304 can be used to treat and prevent Pierce's Disease caused by *X. fastidiosa* subspecies *fastidiosa* in grapevines. Thus, bacteriophage Xfas304 and other virulent *Xylella-Xanthomonas* phages identified from these studies have potential use in the protection and treatment of plants against diseases caused by other *X. fastidiosa* subspecies and *Xanthomonas* species.

Bacteria used in the study included *X. fastidiosa* strains Temecula (XF15) and XF54, associated with Pierce's Disease of grapevines in California and in Texas, respectively. Cultures of *X. fastidiosa* were maintained on PW-M agar medium (Summer et al., *J Bacteriol* 192(1): 179-190, 2010) at 28° C. for 5-7 days. Five-day-old cultures of the *X. fastidiosa* isolates grown on PW-MA were used to make bacterial suspensions in phosphate buffer (0.125 M, pH 7.1) for vine inoculations.

Dormant *V. vinifera* cv. Cabernet Sauvignon clone 08 on 1103P rootstock were purchased from Vintage Nurseries (Wasco, Calif., USA). Vines were planted in 7-gallon pots using 101 Sunshine Mix 1 (Sun Gro Horticulture, Vancouver, British Columbia, Canada). Plants were grown in a greenhouse on a 16-h light (26° C., 300-400 μE/m$^2$·s)/8-h dark (18° C.) cycle supplemented with illumination from sodium vapor lamps. Plants were irrigated every other day with tap water. Every 15 days, the vines were fertilized with Peter's General Purpose 20-20-20 fertilizer and micronutrients. Plants were progressively pruned to provide uniform plants as follows: upon producing two unbranched solitary shoots of 100-150 cm, two shoots were pruned to 80 cm. Lateral shoots and buds were removed. Two cordons were staked and allowed to grow until each cordon was ~2.5-2.75 m in length before vines were used for the above-experiments.

Standard qRT-PCR line plots were obtained for *X. fastidiosa* strains XF15 and XF54, as well as for bacteriophage Xfas304, all of which had $R^2$ values of greater than 0.9 and efficiencies of 157%, 130%, and 123%, respectively. Quantitative assessment of duplicate cordons from triplicate samples of XF15 and XF54 showed distribution of the pathogens throughout all segments assayed, with typical Pierce's Disease (PD) symptoms visible, such as leaves become slightly yellow or red along margins, respectively, and eventually leaf margins dry or die in its zones by week 8 post-inoculation (FIG. 6). In vines inoculated with bacteriophage Xfas304, in the absence of a permissive host, a progression in the distribution of bacteriophage at weeks at 2, 4, and 6 weeks post-inoculation was observed, with a decline between weeks 8-12 and no vine symptoms.

Example 12

Grapevine Inoculation with Bacteria and Bacteriophage

For therapeutic evaluation of bacteriophage treatment, 15 vines (two cordons each) were inoculated with *X. fastidiosa* strains XF15 or XF54. Bacterial suspensions used for inoculation were adjusted spectrophotometrically ($A_{600}$=0.4; $1\times10^9$ CFU/ml). Average of qRT-PCR results from three segments (e.g. 1/1a, 1/1b, 1/1c) with similar locations from triplicate vines was used to determine the CFU/gram plant tissue (gpt) and PFU/gpt. Individual cordons were inoculated between the second and third node on opposite sites (two points/cordon) with 40 μl of the bacterial suspension using the needle inoculation technique as described by Hopkins (*Plant Dis.* 89:1348-1352, 2005). Control vines were mock inoculated with phosphate buffer following the same protocol. Four week post-inoculation with the pathogen, the 15 vines from each treatment were challenged with 40 μl of a bacteriophage Xfas304 suspension ($1\times10^{10}$ PFU/ml) using the same inoculation protocol and technique. Vines were scored for symptom development twice weekly for 12 weeks and assayed in triplicate for *X. fastidiosa* and bacteriophage at the time of inoculation, and at 8, 10, and 12 weeks, as described below. To determine if bacteriophage could act in a preventative manner, nine vines (two cordons each) were inoculated with 40 μl bacteriophage Xfas304 using the same inoculation protocol and inoculation technique as the above. At four weeks post-bacteriophage inoculation, the vines were challenged with 40 μl ($A_{600}$=0.4; $1\times10^9$ CFU/ml) of strain XF15 using the same inoculation protocols as the above.

To evaluate the bacterial and bacteriophage movement in the grapevine, 15 vines each were inoculated with either XF15 or XF54 and 24 vines were inoculated with only bacteriophage Xfas304 using the same inoculation protocols as the above. Vines inoculated with XF15 or XF54 were assayed in triplicate immediately after inoculation and at weeks 8, 10, and 12 post-inoculation. Vines inoculated with bacteriophage were assayed in triplicate immediately after inoculation and every two weeks for 12 weeks. Methods for assay are described below.

To determine how bacteriophage would affect pathogen populations and disease development in vines, *X. fastidiosa* inoculated vines were challenged with bacteriophage Xfas304 at four weeks post-pathogen inoculation. At 8 weeks post inoculation with XF15, vines challenged with Xfas304 at week 4 showed no PD symptoms and the bacterial populations were one to three logs lower in bacteriophage challenged vines as compared to non-challenged vines. The non-bacteriophage challenged plants showed PD symptoms (FIG. 7, column 2), whereas the bacteriophage challenged vines showed no PD symptoms after week 5 (FIG. 7, column 6). During weeks 8 through 12 post-XF15 inoculation (weeks 4 through 8 post-Xfas304 challenge), no PD symptoms were observed in bacteriophage-challenged vines and XF15 populations continued to decline to almost non-detectable levels as compared to non-bacteriophage challenged vines.

A quantitative evaluation of the bacteriophage population in the presence and absence of an introduced host (XF15) indicated that the bacteriophage were able to replicate in sensitive hosts growing in the vines and declined in the absence of a sensitive hosts. Experiments with strain XF54 challenged with Xfas304 at 4 weeks post-pathogen inoculation showed similar results to that observed for XF15 challenged vines. The XF54 population in vine extracts, as measured by CFU/ml of extract, declined from weeks 8 through 12 in bacteriophage challenged vines as compared to that observed in non-bacteriophage-challenged vines. At weeks 8 through 12 post XF54 inoculation (weeks 4 through 8, post-Xfas304 challenge), no PD symptoms were observed in bacteriophage-challenged vines (FIG. 7, column 7). The bacteriophage population increased over the post challenge period in the presences of XF54 and decreased in the absence of a host, again indicating that the bacteriophage was able to replicate in sensitive hosts when present in vines. A summary of the challenge study is presented in FIG. 7, showing that in XF15 or XF54 inoculated vines challenged with bacteriophage Xfas304 (week 4 post-pathogen inoculation) no additional PD symptoms were observed after week 5 (FIG. 7, columns 6 and 7), whereas symptom developed through week 9 and 10 in non-bacteriophage challenged vines inoculated with strain XF15 or XF54, respectively (FIG. 7, columns 2 and 3).

Additional studies were conducted with vines inoculated with bacteriophage Xfas304 and then challenged with XF15 at week 4 post-bacteriophage inoculation to determine the protective (prophylactic) potential of the bacteriophage treatment. At weeks 4 and 8 post-challenge with XF15 vines showed no PD symptoms (FIG. 7, column 8), whereas non-phage treated vines developed symptoms (FIG. 7, column 2). The bacteriophage population increased from week 8 to 12 post challenge period in the presences of XF15 and decreased in the absence of a host.

These results confirm that bacteriophage treatment prevents or reduces PD symptoms by *X. fastidiosa* in a plant and that phage treatment causes no adverse effects to a plant.

Example 13

Sample Collection and Processing

Duplicate cordons from each vine were divided into 5-6 segments and segments were numbered from bottom to top. Each segment was homogenized using a PRO250 homogenizer with 20×115 mm generator (PRO Scientific, CT, USA) in 15 ml of P-buffer (50 mM Tris-HCl, pH 7.5, 100 mM NaCl, 8 mM $MgSO_4$), filtered through sterile cheesecloth (Fisher Scientific, USA) to remove plant tissue debris. For assaying bacteriophage, the filtrate was centrifuged (10,000×g for 15 min) and filter sterilized. The filtrate was used for bacteriophage DNA extraction. The same protocol was used for bacterial assays, except the pellet was resuspended into 1 ml of Milli-Q water for bacterial DNA extraction.

Example 14

Propidium Monoazide (PMA) Treatment of Samples

The PMA protocol as described by Nocker (*J Microbiol Meth* 67:310-20, 2006) was used to exclude dead cells of *X. fastidiosa* from assays used to develop standard curves for assays and for assaying of vine tissue extracts. Briefly, PMA (Biotium Inc., Hayward, Calif.) was dissolved in 20% dimethyl sulfoxide (Sigma-Aldrich, Germany) to yield a stock solution of 20 mM and stored in the dark at −20° C. A volume of 1.25 µl of the PMA stock solution was added to 500 µl *X. fastidiosa* cell suspensions ($A_{600}$=0.4; 1×10$^9$ CFU/ml) or extracts from control and inoculated vines. Preparations were incubated in clear microcentrifuge tubes in the dark for 5 min with repeated inversion. Following incubation, the microcentrifuge tubes were placed on ice and exposed to a 650-W halogen light source (Ushio, USA) at a distance of 20 cm for 1 min. The tubes were swirled briefly by hand every 15 s and inverted after 30 s of illumination to ensure complete cross-linking of the available DNA and the conversion of free PMA to hydroxylamino propidium. After photo-induced cross-linking, viable cells were collected by centrifugation at (12000×g for 2 min at 25° C.) and washed with 500 µl sterile distilled water and resuspended Milli-Q water for DNA extraction.

Bacterial DNA was extracted from PMA treated cell preparations and vine extracts using a ZR Fungal/Bacterial DNA Miniprep (Zymo Research, USA) as per the manufacturer's instructions.

Bacteriophage DNA from control preparations and from plant extracts was extracted using Wizard DNA Clean-up system (Promega, WI, USA) with modifications as described by Summer (*Methods Mol. Biol.* 502:27-46, 2009).

Example 15

Detection of *X. fastidiosa* and Bacteriophage Xfas304 Using Real Time-PCR

A SYBR-green based Real Time-PCR (RTPCR) was performed on the 7500 Real-Time PCR System (Applied Biosystems, CA, USA) using the *X. fastidiosa*-specific primers INF2 5'-GTTTGATTGATGAACGTGGTGAG-3' (SEQ ID NO:1) and INR1 5'-CATTGTTTCTTGGTAG-GCATCAG-3' (SEQ ID NO:2) designed for the gyr B (Bextine and Child, *FEMS Microbiology Letters* 276: 48-54, 2007), and bacteriophage Xfas304-specific primers 304-PrimF 5'-AAGAAGCGTGGTTTGTTTGC-3' (SEQ ID NO:3) and 304-PrimR 5'-CTACCGGCTTCCCTAACTCC-3' (SEQ ID NO:4) designed for the DNA primase gene. A master mix was made using 10 µl of Express SYBR GreenER SuperMix (Invitrogen), 0.4 µl of both primers (at a concentration of 10 µM), 8.56 µl of sterile molecular grade water, 0.04 µl of ROX reference dye (Invitrogen), and 1 µl DNA template per reaction. Standardized conditions were used for all reactions with an initial denaturing step of 3 min at 95° C., followed by 40 cycles of the following parameters: 95° C. for 30 s, 55° C. for 30 s, and 72° C. for 30 s. At the end of the PCR, the temperature was increased from 72 to 99° C. at a rate of 0.5° C./10 s, and the fluorescence was measured every 10 s. Each DNA sample was analyzed in triplicate. As a positive control, DNA was extracted from *X. fastidiosa* cells and from bacteriophage Xfas304 lysates using methods described the above. Cycle threshold (Ct)

values, describing the PCR cycle number at which fluorescence rises above the base line, were determined using the software package provided by the Applied Biosystems.

To determine the Standard curve for absolute quantification, 1-ml volumes of XF15 and XF54 cell suspensions of $1\times10^8$ CFU/ml were treated using the PMA protocol. Bacterial DNA was extracted as described above, serially diluted from $1\times10^{-1}$ to $1\times10^{-5}$ and subjected to the real-time PCR assay described above. Similarly, bacteriophage DNA was extracted from 1 ml volume of $1\times10^9$ PFU/ml bacteriophage Xfas304 as described above, diluted from $1\times10^{-1}$ to $1\times10^{-6}$ and subjected to the real-time PCR assay. Three replicates of each sample for *X. fastidiosa* and bacteriophage Xfas304 were used to produce the standard curves. Standard curves were constructed by plotting Ct values generated from real-time PCR against *X. fastidiosa* DNA concentrations (Log DNA conc./µl as determined by $A_{260}$). The efficiency (E) was calculated as follows: $E=10^{(-1/slope)}-1$ (Klein et al., *Electrophoresis* 20:291-299, 1999).

Example 16

Lysogen Formation Assay Studies

To assay for phage lysogen-formation, survivors of phage infection were tested for the presence of prophages. For each phage, bacteria were infected with at an input MOI of ~3 and plated in a soft agar overlay. Plates were monitored for colony growth (10-15 days for *X. fastidiosa* strain Temecula and 2-3 days for *Xanthomonas* strain EC-12). Individual colonies that emerged were picked, purified (three times) and re-tested for phage sensitivity by spotting dilutions of the same phage in a soft agar overlay. Primer pairs specific to the Xfas 103 and Xfas 106 helicase gene, or Xfas 303 and Xfas 304 primase gene (Table 5) were then used to test for the presence of prophage sequences in the phage-insensitive isolates. Wild type bacterial DNA was used as negative control and wild type bacterial DNA spiked with phage DNA served as positive controls.

To test whether evidence could be found for abortive lysogeny (i.e., the establishment of repression), the procedure of Gill et. al (Gill J. J., et al., *J. Bacteriol.*, 193:5300-5313 (2011)) was followed, except reversibly bound phage were removed by three successive washes. Liquid cultures of logarithmically growing *Xanthomonas* strain EC-12 were cultured to an OD600 of ~0.3-0.5. One ml aliquots were pelleted by centrifugation and resuspended in 0.20 ml of phage lysate (harvested in TNB) or sterile TNB. After a 30 min incubation at 25° C. cell-phage mixtures were centrifuged and the supernatant removed and titered to determine adsorbed phage. In preliminary experiments it was determined that phage were reversibly bound, which affected the MIOactual calculation (Kasman, L. M., et al., *J. Virol.*, 76:5557-5564 (2002)). To circumvent this problem and to obtain an accurate MOIactual, cells were resuspended in sterile TNB, allowed to incubate for 5 min at 25° C., centrifuged and supernatants removed. This procedure was repeated three times to remove unbound phage. Each supernatant was titered to determine PFU. Cell pellets were resuspended in 0.20 ml of sterile TNB, serially diluted and plated to enumerate the bacterial survivors remaining following phage exposure. From these data, the MOIactual, i.e., the ratio of the number of adsorbed phage to the number of CFU in the phage-free controls) was calculated. These MOIactual values were used to calculate the predicted proportion of uninfected cells using the Poisson distribution. This experiment was replicated three times, using both Xfas 103 and Xfas 303.

Lysogeny

To examine the potential for lysogeny, 40 phage-insensitive isolates of *X. fastidiosa* strain Temecula and *Xanthomonas* strain EC-12 each were recovered following a challenge by phage Xfas 103, Xfas 106, Xfas 303 or Xfas 304. PCR using phage specific primers did not detect the presence of phage lysogens in resistant isolates, indicating resistance was not due to lysogeny. Additionally, the potential for abortive lysogeny was examined using infection at a high MOI and measuring survival (Gill et. al (2011)). As shown in Table 4, following infection, there was no significant difference between predicted and actual survivors, indicating phage infection at a high MOI did not lead to the establishment of repression. Together, these results indicate there is no evidence for lysogeny or repression, supporting the conclusion that the four phages are virulent.

TABLE 4

Predicted bacterial survivors based on MOIactual compared to measured bacterial survivors of *Xanthomonas* strain EC-12 following exposure to phage Xfas 103 or Xfas 303a.

| | Replicate No. | $MOI_{actual}$ | Predicted % surviving cells | Measured % surviving cells | Fold excess of survivors vs. prediction |
|---|---|---|---|---|---|
| Xfas 103 | 1 | 6.51 | 0.15 | 0.12 | 0.8 |
| | 2 | 5.57 | 0.38 | 0.25 | 0.65 |
| | 3 | 5.99 | 0.30 | 0.24 | 0.80 |
| Xfas 303 | 1 | 5.40 | 0.45 | 0.38 | 0.80 |
| | 2 | 5.39 | 0.45 | 0.49 | 1.08 |
| | 3 | 5.52 | 0.40 | 0.37 | 0.92 | a Predicted survivors were calculated from the Poisson distribution for the measured MOIactual. Data shown are from three independent replicate experiments.

Example 17

Phage Cocktail Protection and Prevention Studies

Bacterial Strains, Phages, and Inoculum Preparation:

Bacterial isolates used in the study were *X. fastidiosa* strains Temecula (XF15) and XF54 (see Example 3). Cultures of *X. fastidiosa* were maintained on PW-M as described in Example 1. XF15 and XF54 inocula were prepared as described in Example 11. High-titer phage lysates of Xfas303, Xfas304, Xfas103 and Xfas106 ($1\times10^{10}$ PFU/ml) were prepared and titered as described in Example 3. The phage cocktail was prepared by mixing each of the four phages to obtain a final concentration of $1\times10^{10}$ PFU/ml for each phage in the cocktail.

Grapevine Inoculation with Bacteria and Phage Cocktail:

Grapevines were inoculated with either *X. fastidiosa* strain XF15 or XF54 to evaluate bacterial movement in the grapevine. Grapevines were assayed in triplicate immediately after inoculation (0 min) and at 8 and 12 weeks post-inoculation. Additionally, grapevines inoculated with XF15 or XF54 were challenged 3 weeks post-inoculation with the phage cocktail to evaluate therapeutic efficacy. Phage cocktail-inoculated grapevines were challenged at week 3 post-phage inoculation with either XF15 or XF54 to evaluate preventative efficacy of the cocktail. Grapevines from each treatment were scored for symptom development twice weekly. To determine distribution of individual phages comprising the cocktail, grapevines were assayed at weeks 0, 2, 4, 6, 8, 10, and 12 post-inoculation as described below. Grapevines inoculated in either phage or pathogen challenge studies were assayed for phage and/or *X. fastidiosa* infection at weeks 0, 6, 8, 10, and 12 as described below. Control grapevines were assayed at 0, 8, and 12 weeks post inoculation to monitor pathogen distribution and disease development. All grapevine assays were conducted in triplicate with vines containing two cordons. Each cordon (e.g. Cordon1=S1, or Cordon2=S2) was divided into 5-6 (5 inch) segments. Vine segments were numbered from point of inoculation (0) and numbered as below (−) or above (+) the point of inoculation in 5 inch segments. The root portion was divided into three segments: R1, R2, or R3.

Sample Collection and Processing:

For quantification of cocktail phages and pathogens, samples were obtained as described in Example 13. For assaying of phages, the filtrate was centrifuged (10,000×g at 4° C. for 15 min) and filter sterilized. The filtrate was used for phage DNA extraction to accomplish quantitative real-time PCR (qRTPCR) (See below). The same protocol was used for bacterial assays except the pellet was resuspended into 1 ml of Milli-Q water for isolation of bacterial DNA used in qRTPCR. Average of qRTPCR results from three segments (e.g. 0a, 0b, 0c) with similar locations from triplicate vines was used to determine the CFU and PFU. To determine if phage-resistant *X. fastidiosa* would develop as a result of phage challenge experiments, samples collected from grapevines at week 12 post-pathogen inoculation were processed as described in Example 13. Briefly, 100 µl of a suspension of the pellet in 1 ml Milli-Q was plated on PW-MA (Example 1) supplemented with 40 µg/ml cycloheximide (PW-MAC) and incubated at 28° C. After 10-12 days, individual colonies were picked and streak-purified 3 times on PW-MAC. Representative individual colonies (20 colonies total) from each grapevine sample were confirmed at the species and subspecies level using PCR analysis as described by Hernandez-Martinez et al. (Example 1). Phage sensitivity of confirmed isolates was determined by the serial dilution spot assay on overlays and soft agar overlay method as described in Example 3.

PMA Treatment and qRTPCR:

PMA treatment and SYBR-green based qRTPCR protocols were conducted as described in Example 15 using *X. fastidiosa*-specific primers INF2 (SEQ ID NO:1) and INR1 (SEQ ID NO:2) and bacteriophage-Xfas303 specific primers 303-PrimF (SEQ ID NO:5) and 303-PrimR (SEQ ID NO:6), Xfas304 specific primers 304-PrimF (SEQ ID NO:3) and 304-PrimR (SEQ ID NO:4), Xfas103-specific primers 103-HelF (SEQ ID NO:7) and 103-HelR (SEQ ID NO:8); and Xfas106-specific primers 106-HelF (SEQ ID NO:9), and 106-HelR (SEQ ID NO:10) listed in Table 5.

TABLE 5

Primers used for qRT_PCR (SEQ ID NOs. 1-10).

| Primer Set | Sequence | Specific organism and gene | Reference |
|---|---|---|---|
| INF2 | GTTTGATTGATG AACGTGGTGAG | *Xylella fastidiosa*, gyr B | Bextine and Child, 2007 |
| INR1 | CATTGTTTCTTG GTAGGCATCAG | | |
| 303-PrimF | AACTACCTGACA GCGACT | Xfas303, primase | This work |
| 303-PrimR | CGTACTAGCTTG GCTTCTA | | |
| 304-PrimF | AAGAAGCGTGGT TTGTTTGC | Xfas304, primase | This work |
| 304-PrimR | CTACCGGCTTCC CTAACTCC | | |
| 103-HelF | AACCTGATCTGG TACGAC | Xfas103, helicase | This work |
| 103-HelR | GGACATTTTTCA GTTCTCTC | | |
| 106-HelF | CAACCTCATCTG GTATGAC | Xfas106, helicase | This work |
| 106-HelR | GTCTTGGGTAAT TTCTTTCT | | |

*All PCR reactions were conducted for 40 cycles with denaturation at 95° C. for 30 sec, annealing at 55° C. for 30 sec and extension at 72° C. for 30 sec.

Movement of *X. fastidiosa* and Disease Development in Grapevines:

Quantitative assessment of duplicate cordons from triplicate samples of XF15 or XF54 inoculated grapevines showed pathogen distribution in grapevine segments assayed. qRTPCR detected the presence of an average of $1\times10^4$ and $1\times10^5$ CFU/gm of plant tissue (gpt) of XF15 in segment (Seg) S1/1 (cordon 1, 5 inch segment 1 above the point of inoculation) and S2/1 respectively, and an average of $1\times10^4$ CFU/gpt of XF54 in S1/2 and S2/2 at week 8-post inoculation. Typical Pierce's Disease symptoms were visible, such as leaves becoming slightly yellow or red along margins, and leaf margins dried or necrotic by week 8, post-inoculation in non-cocktail challenge grapevines. At week 12 post-inoculation, an average of $1\times10^4$ and $1\times10^6$ CFU/gpt of XF15 was detected in S1/3 and S2/2, respectively. At the same assay interval, an average of $1\times10^5$ and $1\times10^4$ CFU/gpt of XF54 was detected in S1/3 and S2/1, respectively, at week 12 post inoculation, with grapevines exhibiting PD symptoms. Both pathogens (XF15 and XF54) were detected in the root system of grapevines at weeks 8 and 12 post pathogen inoculation at an average of $1\times10^1$-$1\times10^2$ CFU/gpt.

Figure 8:
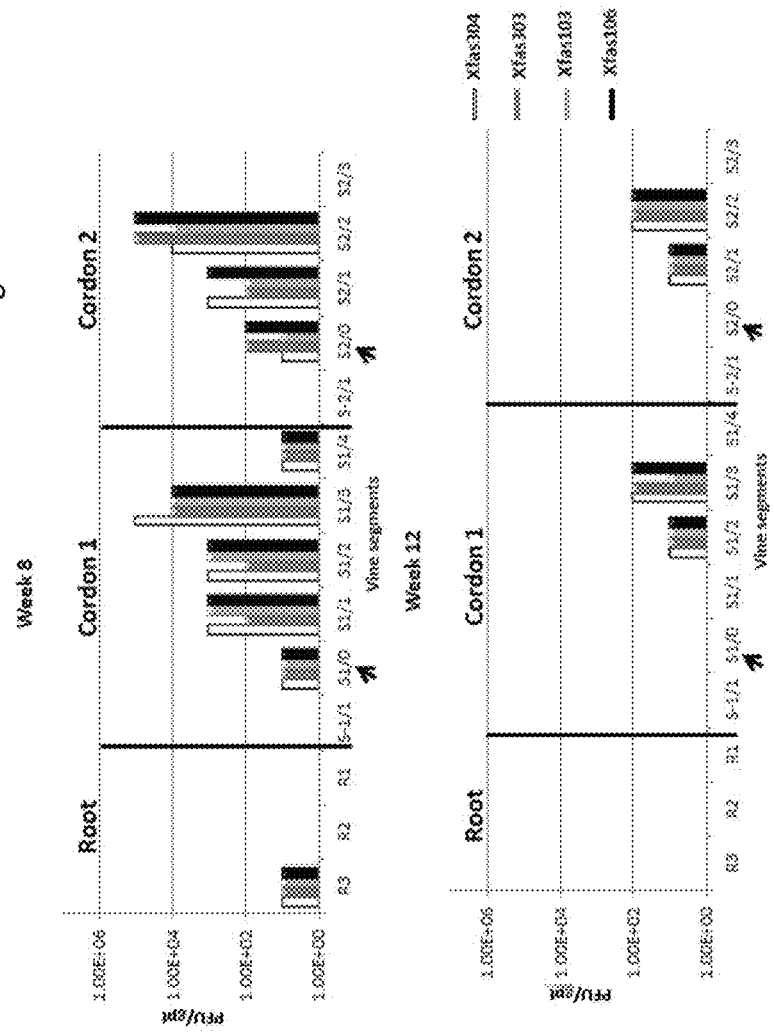
FIG. 8: Shows movement and persistence of individual bacteriophages in inoculated grapevines at 8 (Top) and 12 (Bottom) weeks after phage inoculation. Left panel: phages present in root tissue. Middle panel: phages present in cordon 1 of grapevine. Right panel: phages present in cordon 2 of grapevine.

Phage Movement and Persistence in Grapevines:

Standard qRTPCR line plots were obtained for phage Xfas303, Xfas304, Xfas 103, and Xfas 106 that had R2 values of greater than 0.9 and efficiencies of 127%, 123%, 129%, and 120%, respectively. Quantitative assessment of duplicate cordons from triplicate samples of grapevines inoculated with phage cocktail (Xfas303, Xfas304, Xfas103, and Xfas106) showed distribution of all phages individually within grapevine segments assayed at weeks 2-8 post-cocktail inoculation (FIG. 8). By weeks 8 and 12, individual phages were no longer detectable in roots and had declined to an average of $1\times10^1$-$1\times10^2$ PFU/gpt by week 12 in segments assayed with no grapevine symptoms observed (FIG. 8).

Therapeutic Efficacy of Phage Against *X. fastidiosa* in Grapevines:

Grapevines inoculated with XF15 were challenged with the phage cocktail at three weeks post pathogen inoculation.

Figure 9:
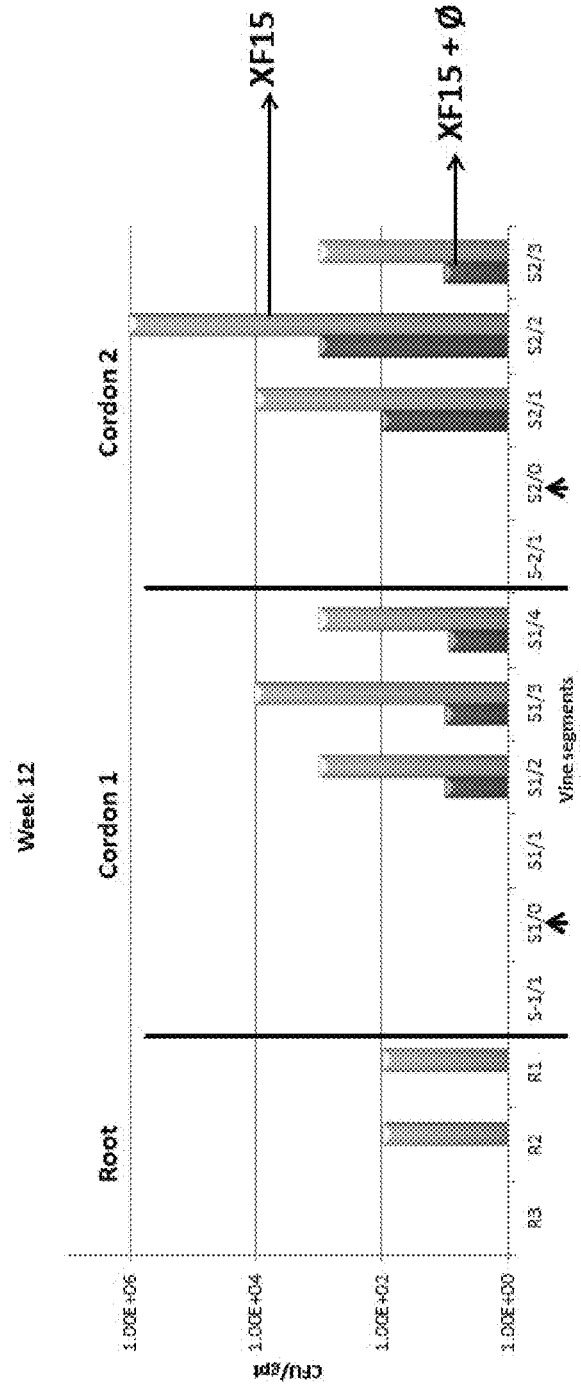
FIG. 9: Shows levels of XF15 in inoculated grapevines challenged with phage cocktail 3 weeks later. Samples were collected 9 weeks after phage cocktail challenge (12 weeks after bacterial inoculation). Left panel: bacteria present in root tissue. Middle panel: bacteria present in cordon 1 of grapevine. Right panel: bacteria present in cordon 2 of grapevine. Gray bars show XF15 levels in XF15 inoculated vines. Black bars show XF15 levels in XF15 inoculated vines challenged with phage cocktail at week 3-post pathogen inoculation. Arrows show segment with point of inoculation. Each bar is representative of average CFU/gpt (gram plant tissue) of roots and 2 cordons for 3 vines.

At 8 weeks (5 weeks post cocktail challenge), the XF15 population was an average of 2-3 logs higher in non-challenged grapevines compared to challenged grapevines. Non-therapeutically treated grapevines showed typical PD symptoms, whereas challenged grapevines did not. At week 12 post-XF15 inoculation (9 weeks post-cocktail challenge), bacterial populations were an average of 2-3 logs higher in non-challenged grapevines when compared to phage cocktail challenged grapevines (FIG. 9). PD symptoms were not observed in phage challenged grapevines throughout the trial (12 weeks), whereas non-cocktail treated grapevines exhibited symptoms as early as 4 weeks, which progressed through week 12. Similarly, the bacterial population in grapevines challenged with XF54-inoculated cocktail declined significantly from weeks 8 through 12 compared to non-challenged grapevines, with no symptoms observed in cocktail-challenged grapevines. Plating of plant extracts from 12-week cocktail-challenged grapevines yielded an average of $1\times10^2$ CFU/gpt. Representative isolates (20 ea) confirmed as *X. fastidiosa* from each cordon of each of three grapevines were all sensitive to the four phages that composed the cocktail.

Prophylactic Efficacy of Cocktail Treatment for the Prevention of PD in Grapevines:

Prophylactic efficacy of the phage cocktail was evaluated by first inoculating grapevines with the cocktail and then challenging with *X. fastidiosa* strain XF15 or XF54 at week 3 post-cocktail inoculation. Grapevines treated prophylactically showed no PD symptoms at weeks 8 and 12 post-cocktail inoculation. In cocktail-inoculated grapevines that were challenged with XF15, pathogen populations reached a maximum of an average of $1\times10^3$ CFU/gpt in the segments of the grapevines examined at weeks 8 and 12, and as high as an average of $1\times10^6$ CFU/gpt in non-prophylactically treated grapevines. Similar results were observed in grapevines treated prophylactically with cocktail and then challenged with XF54 at week 3 post phage cocktail inoculation. Plating of plant extracts from 12-week cocktail challenged-grapevines yielded an average of $3\times10^2$ CFU/gpt. Representative isolates (20 ea) confirmed as *X. fastidiosa* from each cordon from each of three grapevines were all sensitive to the four phages that composed the cocktail.

Figure 10:
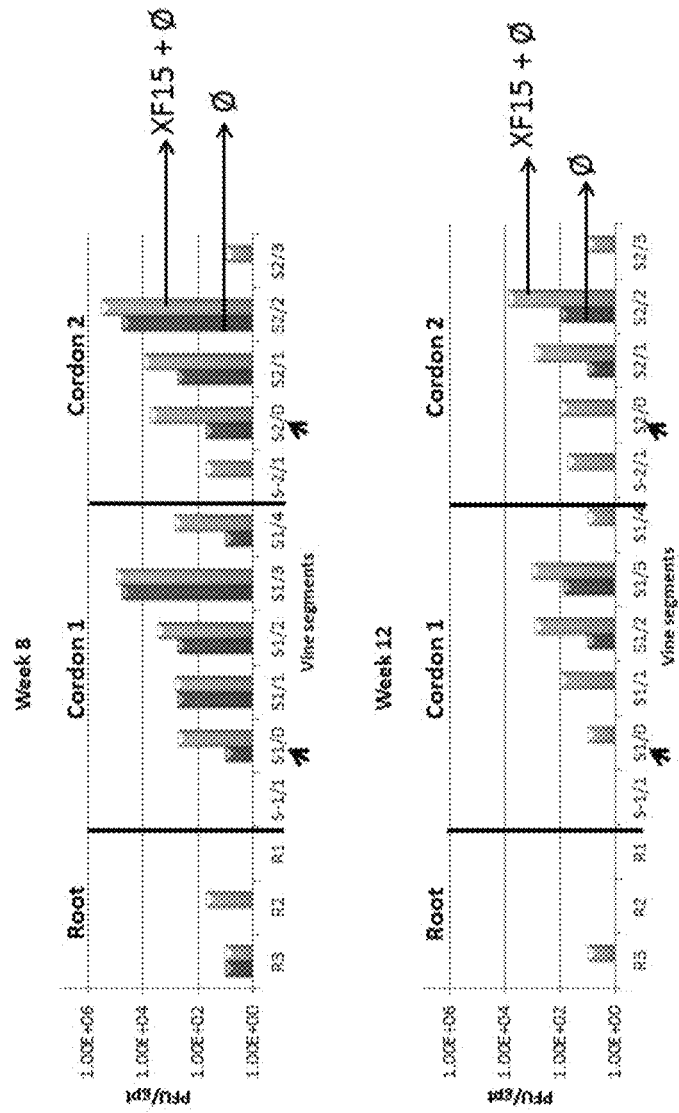
FIG. 10: Shows levels of cocktail phages in grapevines initially inoculated with XF15 and challenged with phage cocktail 3 weeks later. Samples were collected 5, 7, and 9 weeks after phage cocktail challenge (8, 10, and 12 weeks after initial bacterial inoculation). Left panel: phages present in root tissue. Middle panel: phages present in cordon 1 of grapevine. Right panel: phages present in cordon 2 of grapevine. Black bar show phage levels in cocktail inoculated plants. Gray bar show phage levels in XF15 inoculated vines challenged with phage cocktail at week 3-post pathogen inoculation. Arrows show segment with point of inoculation. Each bar is representative of the average PFU/gpt (gram plant tissue) of 4 phages in cocktail determined from roots and 2 cordons for 3 vines.
Figure 11:
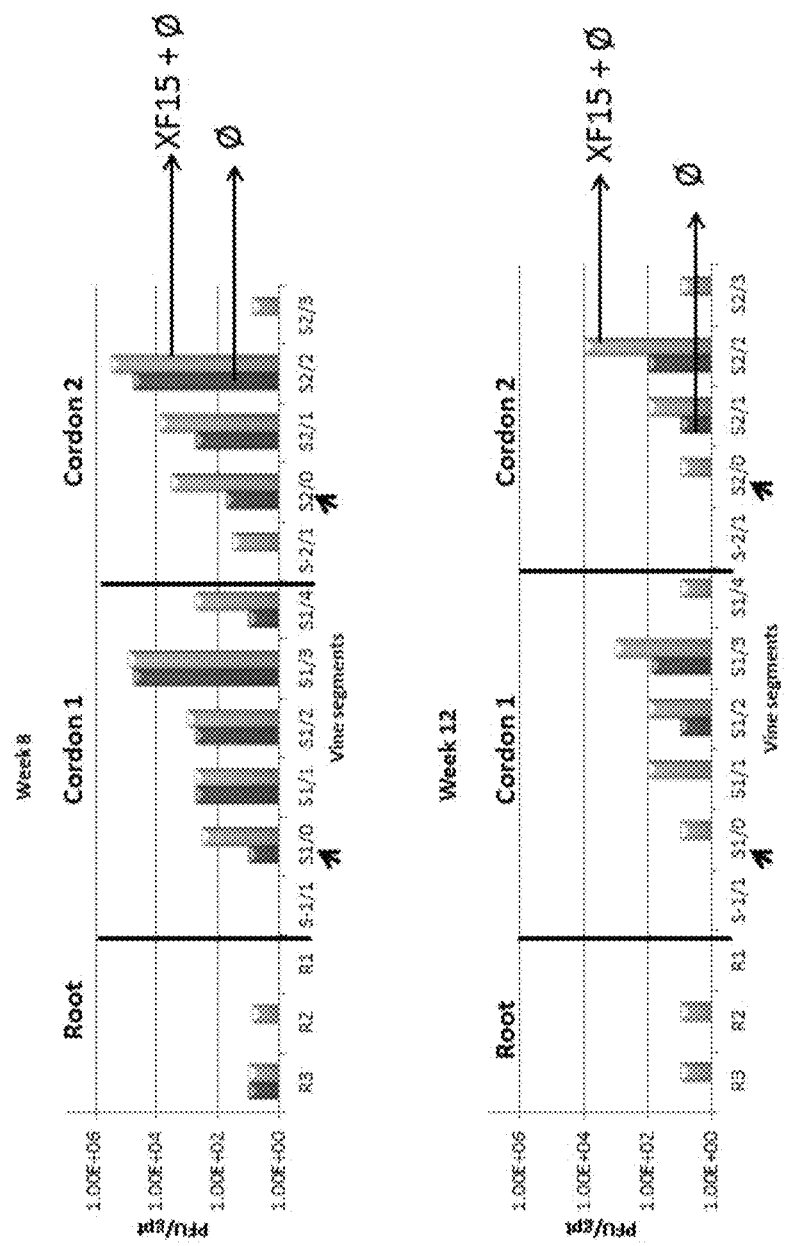
FIG. 11: Shows levels of phages in grapevines initially inoculated with phage cocktail and challenged 3 weeks later with XF15. Samples were collected 5, 7, and 9 weeks after XF15 challenge (8, 10, 12 weeks after initial phage inoculation). Left panel: phages present in root tissue. Middle panel: phages present in cordon 1 of grapevine. Right panel: phages present in cordon 2 of grapevine. Black bars show phage levels in cocktail inoculated vines. Gray bars show phage levels in cocktail inoculated vines challenged with XF15 at week 3-post phage inoculation. Arrows show segment with point of inoculation. Each bar is representative of the average PFU/gpt (gram plant tissue) of 4 phages in cocktail determined from roots and 2 cordons for 3 vines.
Figure 12:
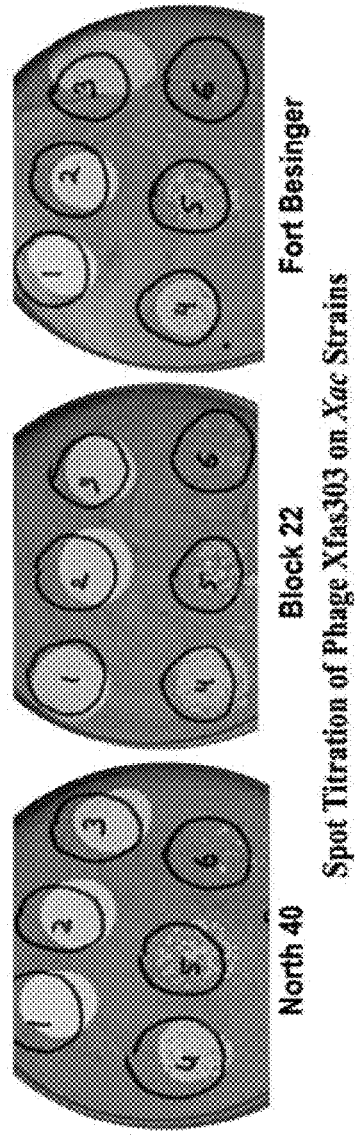
FIG. 12: Shows results of spot titration of phage Xfas303 on *Xanthomonas axonopodis* pv. *citri* strains.

Persistence and Replication of Phages in Grapevines:

It was of interest to determine phage populations in grapevines in the presence or absence of introduced hosts (XF15 and XF54). Quantitation of phage populations in the presence or absence of hosts confirmed that the cocktail phages were able to replicate and maintain higher populations if sensitive hosts were present in grapevines and then declined in the absence of a sensitive host in both the therapeutic and prophylactic studies (FIGS. 10 & 11). Phage populations in non-host containing grapevines decreased during weeks 8-12, whereas phage populations increased an average of 1-2 logs during the same period in grapevines inoculated with XF15 or XF54 and challenged (therapeutic treatment) with phage cocktail (FIG. 10). Similar results were obtain in prophylactic study, with phage populations increasing an average of 1-2 logs over that observed in non-host containing grapevines (FIG. 11). These results confirmed that bacteriophage treatment prevents or reduces PD symptoms by *X. fastidiosa* in a plant and demonstrates no adverse effect to a treated plant.

Example 18

Transmission of *X. fastidiosa* by the Glassy-Winged Sharpshooter

The glassy-winged sharpshooter (GWSS), *Homalodisca vitripennis*, is a xylem-feeding leafhopper that transmits *X. fastidiosa* subsp. *fastidiosa* (Xff). The GWSS is prevalent throughout grape growing regions of southern California and Texas. Laboratory-reared Xff-free GWSSs were fed on cowpea (*Vigna unguiculata* subsp. *unguiculata*) plants harboring either *X. fastidiosa* or virulent phage Xfas304 for 48 h in three trials to examine the uptake of Xff or phage by GWSS. To determine the ability of GWSSs to transmit bacteria or phage to plants, GWSSs harboring bacteria or phage were fed on bacteria and phage-free plants. A subset of bacteria harboring GWSSs were challenged by feeding them on plants harboring phage for 48 or 96 h. GWSSs and plants were assayed individually in all experiments to evaluate uptake, transmission or persistence of bacteria and/or phage using qRTPCR. GWSSs were able to uptake and transfer Xff and/or phage. In GWSSs harboring Xff and challenged with phage, the titer of phage Xfas304 increased two-fold, as compared to that observed in Xff-free GWSSs. A two-fold decline in bacterial population was observed in GWSSs when challenged with phage Xfas304, as compared to non-challenged. GWSSs transmitted Xff and/or phage to plants.

Bacterial Strains, Phages and Inoculum Preparation:

*X. fastidiosa* strain XF54 (See Example 1) and phage Xfas304 (See Example 3) were used in this study. Culture of XF54 was grown on PW-M as described in Example 1. Five-day-old culture of XF54 grown on PW-MA was used to make bacterial suspensions in phosphate buffer (0.125 M, pH 7.1). High-titer phage lysate of Xfas304 ($1\times10^{10}$ PFU/ml) was prepared and titered as described in Example 3 in sterile deionized water (SDW).

Plant Growth Conditions and Preparation:

Cowpea (*Vigna unguiculata* subsp. *unguiculata*) plants were used as host for GWSSs. Cowpea seeds were planted using 101 Sunshine Mix 1 (Sun Gro Horticulture, Vancouver, British Columbia, Canada). Cowpea were grown in a growth chamber on a 16 h light (26° C., 300-400 µEm-2 s-1)/8 h dark (18° C.) cycle supplemented with illumination from sodium vapor lamps. Cowpea were watered every other day with tap water and fertilized with Peter's General Purpose 20-20-20 fertilizer and micronutrients every 15 days.

Glassy-Winged Sharpshooter:

Insects used in experiments were laboratory-reared, young adults (<3 week old), which were initially obtained from the rearing facility at the California Department of Food Agriculture (CDFA) Field Station, Arvin, Calif. The laboratory colony was originally collected mainly from citrus orchards in Ventura County, Calif. At the CDFA rearing facility, the laboratory colonies of *H. vitripennis* were reared from egg stage on multiple host plants under greenhouse conditions at 31±4° C., under high-intensity sodium lighting with a photoperiod of 16:8 (L:D) h. The CDFA *H. vitripennis* colonies were maintained on several host plants including cowpea *Vigna unguiculata* [L.] Walp), sunflower (*Helianthus annuus* L.), Japanese euonymus (*Euonymus japonica* Thunb.), and sorghum (*Sorghum bicolor* [L.] Moench). The *H. vitripennis* laboratory colony was replenished by introducing eggs laid by field-collected females as needed. Adult insects were overnight express shipped from Arvin, Calif. to College Station, Tex. in plastic containers containing cowpea and basil placed in Styrofoam shipping containing a frozen cold pack. The GWSSs used in this study were young adults with an approximate sex ratio of 55% males. The GWSSs were housed in the Biological Control Facility, Department of Entomology at Texas A&M University. After receiving, insects were fed on cowpea plants, maintained at 24° C. to 29° C. (16 and 8 h of light and dark, respectively), for two days to allow for adaption to chamber conditions. Prior to use, three GWSSs from each lot were processed to insure the absence of Xff and phage using qRT-PCR. The GWSSs were housed in the Biological Control Facility, Department of Entomology at Texas A&M University. After receiving, insects were fed on cowpea plants, maintained at 24° C. to 29° C. (16 and 8 h of light and dark, respectively), for two days to allow for adaption to chamber conditions. Prior to use, three GWSSs from each lot were processed to insure the absence of Xff and phage using qRT-PCR.

Experimental Design:

Each experimental unit (i.e., cage) contained a 15-cm-long stem of cowpea at the 3-4 leaf stage and a 50 ml flat-bottom tube with a 50-ml suspension of phage or bacteria in SDW as appropriate. Cowpea stems with attached leaves at the 3-4 leaf stage (cut stem) were collected from two- or three-week-old plants inserted through a hole in the cap and anchored in place with Parafilm (cut stem anchored). GWSSs (3 GWSS/cut stem/cage) were placed in cages and allowed to feed as appropriate.

Uptake of X. fastidiosa and Phage by GWSSs:

To determine uptake of X. fastidiosa and/or phage by GWSSs, cowpea cut stems with attached leaves were anchored in a tube filled with an Xff ($1\times10^9$ CFU/ml) or phage Xfas304 ($1\times10^{10}$ PFU/ml) suspension for 4 h to allow for capillary uptake of Xff or phage. Control cut stems were placed in SDW. After allowing cut stems to uptake the appropriate suspension for 4 h, a subset (3 cut stems) was assayed to quantify X. fastidiosa or Xfas304. After the 4-h uptake period, GWSSs (3 GWSSs/cut stem/cage) were allowed to feed on cut stems. Each experimental set was done in triplicate (1 cut stem×3 GWSSs×3 cages). After 48 h, all cowpea cut stems and GWSSs were assayed to quantify the presence of Xff and/or phage by qRTPCR. Water uptake controls were conducted for all experiments under the same conditions and assayed for Xff and phage.

Initial experiments were designed to determine if GWSSs could acquire Xff or phage from cut stems that harbored the pathogen or phage, and if so, whether they could transfer the Xff or phage to other cut stems. After 48 h, cut stems and GWSSs harbored an average of $2\times10^8\pm1\times10^8$ CFU/g of plant tissue (gpt) and $1\times10^6\pm0.7\times10^6$ CFU/GWSS, respectively confirming that GWSSs could acquire X. fastidiosa as previously reported (Bextine et al., Biotechniques 38:184, 186, 2005). In a parallel experiment to determine if phage could be acquired by GWSSs from feeding on cut stems, GWSSs assayed after 48 h harbored an average of $2\times10^6\pm0.9\times10^6$ PFU/GWSS that was acquired from cut stems containing $2\times10^8\pm1\times10^8$ PFU/gpt. The results showed that GWSSs could acquire phage by feeding on cut stems.

Uptake and Transfer of Phage by GWSSs:

To determine phage uptake and transfer by GWSSs, cowpea cut stems (9) were anchored in 50-ml tubes filled with phage Xfas304 suspension ($1\times10^{10}$ PFU/ml). Controls (3 cut stems) were placed in SDW. Both sets of cut stems were allowed to uptake respective medium. After 4 h, three of the cut stems allowed to uptake phage were assayed to determine phage concentration. The remaining 6 cut stems were each placed in individual cages with GWSSs (3 GWSSs/cut stem/cage). After 48 h, 9 GWSSs and their respective 3 cut stems were assayed for phage content and the remaining 9 GWSSs were transferred to fresh cowpea cut stems anchored in SDW (3 GWSSs/cut stem×3 cages) and allowed to feed for an additional 48 h to determine phage transfer to cut stems. Cut stems (3) and GWSSs (9) were assayed for phage after the designated period. Water uptake controls were conducted for all experiments under the same conditions and assayed for phage.

Having determined that both phage and bacteria could be acquired by GWSSs, it was of interest to determine if GWSSs that acquired phage from cut stems could transfer phage and/or bacteria to another cut stem. A subset of phage-harboring GWSSs were transferred to fresh cowpea cut stems in SDW and allowed to feed. After 48 h, the cut stems and GWSSs harbored an average of $3\times10^2\pm2.5\times10^2$ PFU/gpt and $3\times10^3\pm1.6\times10^3$ PFU/GWSSs, respectively, indicating that GWSSs could transfer phage.

Phage Challenge of X. fastidiosa Harboring GWSSs:

To determine if phage could affect the X. fastidiosa population in GWSSs, GWSSs harboring Xff were challenged with phage. Briefly, using methods described above with triplicate replicates, GWSSs fed on Xff-containing cut stems, verified to contain Xff, were transferred to cowpea cut stems uptaking phage Xfas304 and allowed to feed. After 48 or 96 h of feeding, the cut stems and GWSSs were assayed for phage and/or Xff. For uptake of Xff, cowpea cut stems (15) were place in a XF54 suspension ($1\times10^9$ CFU/ml) for 4 h before introducing GWSSs. At 4 h, 3 cut stems were assayed for Xff. Each of the 12 remaining cut stems were placed in cages with 3 GWSSs/cut stem and the GWSSs allowed to feed for 48 h on the Xff containing cut stems. After 48 h, the Xff-fed GWSSs and host cut stems were subdivided into 3 groups: Group 1 was assayed for Xff (3 cut stems and 9 GWSSs); Group 2 (9 GWSSs) was transferred to fresh cowpea cut stems (3) placed in SDW and allowed to feed for 48 h before GWSSs and cut stems were assayed for Xff; Group 3 (18 GWSSs) was transferred to cowpea cut stems (3) placed in a XFas304 suspension ($1\times10^{10}$ PFU/ml) and allowed to feed for 48 or 96 h before the GWSSs and cut stems were assayed for Xff and phage. Water uptake controls were conducted for all experiments under the same conditions and assayed for both X. fastidiosa and phage.

36 GWSSs were allowed to feed on cowpea cut stems in a Xff suspension and then assayed to determine Xff uptake, Xff and/or phage transfer, and effect on phage and/or Xff in GWSSs. GWSSs (Group 1) allowed to feed on cut stems for 48 h that had been placed in a suspension of the Xff strain XF54 ($3\times10^9$ CFU/ml) were determined to harbor on the average $1\times10^6\pm0.7\times10^6$ CFU/GWSSs and the host feeding cut stems were determined to harbor an average of $2\times10^8\pm1\times10^8$ CFU/gpt. After GWSSs harboring Xff (Group 2; $1\times10^6\pm0.7\times10^6$ CFU/GWSS) were allowed to feed on fresh cut stems in SDW for 48 h, the cut stems showed an average of $1\times10^3\pm1.3\times10^3$ CFU/gpt and the GWSSs an average of $2\times10^3\pm1\times10^3$ CFU/GWSSs residual Xff; reconfirming previous results of Xff transfer by GWSSs. Group 3 of the Xff harboring GWSSs transferred to cut stems in an Xfas304 suspension ($2\times10^{10}$ PFU/ml) and allowed to feed for 48 h, showed uptake of phage and persistence of Xff. The assayed GWSSs, at 48 h of feeding, harbored an average of $3\times10^4\pm1.8\times10^4$ PFU/GWSS of Xfas304 and retained $2\times10^3\pm1.1\times10^3$ CFU/GWSSs of XF54. The cut stems assayed at the same time interval contained an average of $3\times10^8\pm2\times10^8$ PFU/gpt and $2\times10^3\pm0.6\times10^3$ CFU/gpt. The GWSSs allowed to feed for 96 h harbored an average of $2\times10^5\pm1.2\times10^5$ PFU/GWSS of Xfas304 and $1\times10^2\pm0.9\times10^2$ CFU/GWSS of XF54, indicating a reduction in XF54 and an average 6-fold increase in Xfas304.

Collection and Assay of Cowpea Cut Stems and GWSSs:

GWSSs were sacrificed by freezing at −20° C. for 5 min and cowpea cut stems were collected by cutting at the junction of the tube cap with sterile razor. Each GWSS of each triplicate was placed into 1.5-ml micro-centrifuge tube with 0.5 ml of P-buffer (50 mM Tris-HCl, pH 7.5, 100 mM NaCl, 8 mM $MgSO_4$), homogenized using a sterile plastic micro-pestle (Fisher), and filtered through sterile cheesecloth (Fisher Scientific, USA) to remove tissue debris. Each cut stem of each of triplicate was weighed and commuted using a sterile razor blade and homogenized in 1 ml of P-buffer using a mortar and pestle and filtered through sterile cheesecloth (Fisher Scientific, USA) to remove tissue debris. For assaying phage, the filtrate was centrifuged (10,000×g for 15 min) and filter sterilized. A portion of filtrate was used for phage DNA extraction as in Example 9, followed by qRTPCR as described below. The remaining portion of the filtrate was used to titer phage as described in Example 3. The same protocol was used for bacterial assays (CFUs), except the pellet was resuspended into 0.5 ml of sterile Milli-Q water for PMA treatment, bacterial DNA extraction, and qRTPCR as described below.

PMA Treatment and qRTPCR:

PMA treatment and SYBR-green based qRTPCR protocols were conducted as described in Example 17 using *X. fastidiosa*- and phage-specific primers.

Example 19

Phage Activity Against *Xanthomonas axonopodis* pv. *citri*

Although previous studies have evaluated the use of phage for the control of citrus canker, no conclusive data confirmed the virulent nature of the phages (Balogh et al., *Plant Disease,* 92:1048-1052, 2008). Only virulent, non-transducing phage should be used to evaluate and implement a sustainable phage biocontrol system. The sensitivity of three Xac field strains (North 40, Block 22, Fort Basinger) obtained from Florida, to two fully characterized virulent phages representative of the Podoviridae (Xfas303) and the Siphoviridae (Xfas103), respectively, was tested. Results indicate that the three Xac strains tested were only sensitive to phage Xfas303 (FIG. 12). Phage Xfas303 was able to form clear plaques on three Xac strains tested. 454 pyrosequencing was performed of the Xfas303 genome and predicted genes were fully annotated. The presence of a single subunit RNA Polymerase (SSRNAP) was found, which is indicative of virulent phages such as T7 and KMV (Dunn et al., *J. Mol. Biol.* 166:477-53521, 1983; Lavigne et al., *Virology* 312:49-59, 2003). Additionally, it was determined that the type IV pili of *Xanthomonas* spp. strain EC-12 is the primary receptor site for the phage Xfas303 by making in-frame deletion mutants of pilA in the bacteria. Both phages Xfas303 and Xfas103 adsorb and form clear plaques on the strain EC-12, but not the ΔpilA derivative, showing results only for plating of phage Xfas303 on EC-12 or EC-12ΔpilA. It was also determined that type IV pili are the primary receptor site for phage Xfas303; thus this phage may have a different secondary receptor site requirement for infection or that phage DNA was restricted. Results indicate that the developed non-Xac dependent procedure may be used to isolate virulent phage for Xac with no loss in efficiency of plating (EOP of 0.75).

Example 20

Evidence for Expression of Type IV Pili in Xac

Reports in the literature are conflicting as to the expression and role of type IV pili in the infection process and pathogenesis of Xac (Brunings et al., *Mol. Plant. Pathol.* 4:141-57, 2003; Li et al., *PLoS ONE* 6:e21804, 2011; Yang et al., *Curr. Microbiol.* 48:251-61, 2004). The results presented above indicate that all three Xac strains tested expressed functional type IV pili, as the pili must be retracted to facilitate adsorption and infection of a phage. Using light microscopy studies the three Xac strains were evaluated for twitching motility, an indicator of functional type IV pili. *Pseudomonas aeruginosa* strain PAO1 and *Xanthomonas* ssp. strain EC-12 were used as positive controls and EC-12ΔpilA was used as a negative control. The three Xac strains (North 40, Block 22 and Fort Basinger) were evaluated for twitching motility. The PAO1, EC-12, and three Xac strains exhibited twitching motility, whereas the EC-12ΔpilA did not. Microscopy studies corroborate results obtained with phage sensitivity testing and indicated that three Xac strain have functional type IV pili that act as an adsorption site for phage Xfas303. Results corroborate the observations of others (Brunings et al., *Mol. Plant. Pathol.* 4:141-57, 2003; Li et al., *PLoS ONE* 6:e21804, 2011; Yang et al., *Curr. Microbiol.* 48:251-61, 2004) that type IV pili are expressed by Xac.

Example 21

Isolation and Characterization of XfaMija and XfaMijo

Bacterial Strains and Culture Conditions.

Bacterial strains used are listed in Table 6. *X. fastidiosa* strains were cultured and maintained in PW-M broth (PW-MB) or on PW-M agar (PW-MA) plates and PW-M soft agar (PW-MSA) (PW-MB with 7.5 g/liter plant cell culture-tested agar) was used for overlays. *Xanthomonas* strain was cultured at 28° C. in tryptone nutrient broth (TNB) or tryptone nutrient agar (TNA) (TNB lacking $KNO_3$ with 20 g/liter agar). TNA soft agar (TNSA) (TNB lacking $KNO_3$ with 7.5 g/liter agar) was used for overlays. Plant extracts were plated onto PW-MA or TNA supplemented with cycloheximide (40 μg/ml), designated PW-MC and TNAC, respectively.

TABLE 6

Bacterial strains used for phage isolation and characterization.

| Strain | Genotype or relevant characteristics | Reference or source |
|---|---|---|
| *Xylella fastidiosa* | | |
| Temecula 1 | *X. fastidiosa* subsp. *fastidiosa*, Wild-type Pierce's Disease isolate, ATCC 700964, twitching motility⁺ | Van Sluys, *J Bacteriol.* 185: 1018, 2003 |

TABLE 6-continued

Bacterial strains used for phage isolation and characterization.

| Strain | Genotype or relevant characteristics | Reference or source |
| --- | --- | --- |
| XF15-1 | Temecula 1; ΔpilA::Km$^r$, twitching motility$^-$ | Ahern, J Bacteriol. 196: 459, 2014 |
| Ann-1 | X. fastidiosa subsp. sandyi, oleander isolate, ATCC 700598, twitching motility$^+$ | Bhattacharyya, Genome Res. 12: 1556, 2002 |
| Dixon | X. fastidiosa subsp. multiplex, almond isolate, ATCC 700965, twitching motility$^+$ | Bhattacharyya, Genome Res. 12: 1556, 2002 |
| XF53 | Grape isolate (subsp. fastidiosa) | Ahern, J Bacteriol. 196: 459, 2014 |
| XF54 | Grape isolate (subsp. fastidiosa) | Ahern, J Bacteriol. 196: 459, 2014 |
| XF95 | Oleander isolate (subsp. sandyi) | Ahern, J Bacteriol. 196: 459, 2014 |
| XF15.7 | X. fastidiosa Temecula 1 Salvo$^{a,R}$, twitching motility$^+$ | This work |
| XF15.11 | X. fastidiosa Temecula 1 Sano$^{a,R}$, twitching motility$^+$ | This work |
| XF15.12 | X. fastidiosa Temecula 1 Prado$^{a,R}$, twitching motility$^+$ | This work |
| XF15.16 | X. fastidiosa Temecula 1 Sano$^{a,R}$, twitching motility$^+$ | This work |
| XF15.28 | X. fastidiosa Temecula 1 Salvo$^{a,R}$, twitching motility$^+$ | This work |
| XF15.37 | X. fastidiosa Temecula 1 Paz$^{a,R}$, twitching motility$^+$ | This work |
| XF15.38 | X. fastidiosa Temecula 1 Paz$^{a,R}$, twitching motility$^+$ | This work |
| XF15.51 | X. fastidiosa Temecula 1 Prado$^{a,R}$, twitching motility$^-$ | This work |
| XF134-155, 161-163 | X. fastidiosa isolate from V. vinifera, Santa Clara County, CA | This work |
| XF156-160, 164, 165 | X. fastidiosa isolate from V. vinifera, Sonoma County, CA | This work |
| XF166-173 | X. fastidiosa isolate from V. vinifera, Napa County, CA | This work |
| XF174-183 | X. fastidiosa isolate from V. vinifera, Uvalde County, TX | This work |
| Xanthomonas | | |
| EC-12 | Xanthomonas sp., rice isolate (ATCC PTA-13101) | Ahern J Bacteriol. 196: 459, 2014 |
| Jal-4 | X. euvesicatoria, jalapeno isolate | Ahern J Bacteriol. 196: 459, 2014 |
| Presidio-4 | Xanthomonas sp., rice isolate | Ahern J Bacteriol. 196: 459, 2014 |
| EC-12-1 | EC-12 unmarked deletion of pilA | Ahern J Bacteriol. 196: 459, 2014 |

Km$^r$ = Kanamycin resistant.
$^a$phage used for selection of phage resistant mutant.
$^R$Resistant to phages Sano, Salvo, Prado and Paz.
$^+$Present
$^-$Absent Bacteriophage Isolation and Purification.

Plant and ditch water samples were assayed for the presence of phage able to form plaques on X. fastidiosa strain Temecula 1. Plant extracts were prepared by macerating 10 g of plant tissue in 50 ml of P-buffer (1) using a mortar and pestle, strained through a sterile double layer of cheese cloth to remove large particles, and filter sterilized. Water sample was centrifuged twice and filter sterilized. Plant and water filtrates were directly screened for phage activity using the spot test and soft agar overlay method on Xanthomonas strain EC-12 as described by Ahern, et al., 2014. Individual plaques formed on overlays of Xanthomonas strain EC-12 were excised, suspended in P-buffer, and filter sterilized, and titers were determined. This procedure was repeated three times to obtain single plaque isolates. Purified phages were tested for activity on X. fastidiosa strain Temecula 1. High-titer phage plate lysates ($1 \times 10^{10}$ PFU/ml) were prepared by harvesting overlay plates of X. fastidiosa strain Temecula 1 or Xanthomonas strain EC-12 exhibiting confluent lysis. After being flooded with 5 ml of P-buffer, the soft agar overlay was macerated, clarified by centrifugation, and filter sterilized. The resulting lysates were stored at 4° C.

Phage DNA Isolation and Genome Sequencing.

DNA was isolated from high-titer phage suspensions. Phage DNA was sequenced in an Illumina MiSeq 250-bp paired-end run with a 550-bp insert library. Quality-controlled, trimmed reads were assembled to a single contig of circular assembly at 30.9-fold coverage using SPAdes version 3.5.0. The contig was confirmed to be completed by PCR using primers that face the upstream and downstream ends of the contig. Products from the PCR amplification of the junctions of concatemeric molecules were sequenced by Sanger sequencing (Eton Bioscience, San Diego, Calif., USA). Genome termini was determined by restriction enzyme digestion profile. Genes were predicted using GeneMarkS and corrected using software tools available on the Center for Phage Technology (CPT) Galaxy. Protein-coding regions were initially predicted by using GeneMark.hmm, Glimmer3 and MetaGeneAnnotator refined by manual analysis in Artemis, and analyzed by using BLAST (E value cutoff of 0.005). Proteins of particular interest were additionally analyzed by InterProScan, HHpred searches.

Transmission Electron Microscopy.

Electron microscopy of high titer phage ($1\times10^{10}$ PFU/ml) was performed by diluting stock with $1/5^{th}$ dilution of P-buffer. Phages were applied onto thin 400-mesh carbon coated Formvar grids, stained with 2% (wt/vol) uranyl acetate, and air dried. Specimens were observed on a JEOL 1200EX transmission electron microscope operating at an acceleration voltage of 100 kV. Five virions of each phage were measured to calculate mean values and standard deviations for dimensions of capsid and tail.

Host Range and Efficiency of Plating.

Host ranges of purified phages (propagated on *X. fastidiosa* strain Temecula 1) were determined by the serial dilution spot test method, as described by Ahern, et al., 2014. A panel of *X. fastidiosa* and *Xanthomonas* isolates were used as indicator hosts. Phage sensitivities of type IV pilus mutants and complements were tested similarly. Efficiency of plating (EOP) was determined by calculating the ratio of the phage plaque titer obtained with a heterologous (non-propagating) host to that obtained with a homologous (propagating) host. All experiments were done in triplicate.

One-Step Growth Curve.

One-step growth curves were used to determine the burst size and latent period of the phages. Liquid cultures of logarithmically growing *Xanthomonas* strain EC-12 were infected with individual phages at a multiplicity of infection (MOI) of ~3 and allowed to adsorb at 28° C. for 5 min. To stop further phage adsorption, cultures were diluted 1,000-fold in TNB. Infected centers were incubated at 28° C. with constant shaking (150 rpm). Samples were taken at 3-min intervals, immediately filter sterilized, and plated in soft agar lawns of *Xanthomonas* strain EC-12. All experiments were done in triplicate.

Bacteriophage Adsorption.

Liquid cultures of logarithmically growing cells (*X. fastidiosa* strain Temecula 1 or *Xanthomonas* strain EC-12) were infected with individual phages (propagated on homologous hosts) at an MOI of ~0.1. The mixture was incubated at 28° C. with shaking (150 rpm). Samples were taken (2-h intervals for *X. fastidiosa* strain Temecula 1 and 2-min intervals for *Xanthomonas* strain EC-12) and immediately filter sterilized, and titers were determined. The rate of phage particle disappearance is defined as $dP/dt=-kBP$, where B is the concentration of bacteria, P is the concentration of free phage at any time (t), and k is the adsorption rate constant in ml cell$^{-1}$ min$^{-1}$. All experiments were done in triplicate.

Lysogen Formation Assay.

To assay for phage lysogen formation, survivors of phage infection were tested for the presence of prophages. For each phage, bacteria were infected at an input MOI of ~3 and plated in a soft agar overlay. Plates were monitored for colony growth (10 to 15 days for *X. fastidiosa* strain Temecula 1 and 2 to 3 days for *Xanthomonas* strain EC-12). Individual colonies that emerged were picked, purified (three times), and retested for phage sensitivity by spotting dilutions of the same phage in a soft agar overlay. Primer pairs specific to Mija and Mijo primase genes (Table 7) were then used to test for the presence of prophage sequences in the phage-insensitive isolates. Wild-type bacterial DNA was used as the negative control, and wild-type bacterial DNA spiked with phage DNA served as the positive control. Phages Mija and Mijo have been shown to be useful in lysogen formation.

TABLE 7

Primers for Mija and Mijo

| Primer Name* | Sequence (5'-3') | SEQ ID NO. | Amplicon size (bp) |
|---|---|---|---|
| Mija-PrimF | TCCCAAGAGTGATTGTATCC | 25 | 221 |
| Mija-PrimR | CTGCGATACAGTTCTCAACA | 26 | |
| Mijo-PrimF | CAAAATCGTCATCTACGACA | 27 | 193 |
| Mijo-PrimR | CTTTTGTTTGGTTTTTGCTT | 28 | |

*All PCR reactions were conducted for 40 cycles with denaturation at 95° C. for 30 sec, annealing at 55° C. for 30 sec and extension at 72° C. for 30 sec.

Test for Abortive Lysogeny.

To test whether evidence for abortive lysogeny (i.e., the establishment of repression) could be found, a procedure described previously by Gill J. *Bacteriol.* 193:5300-5313, 2011 and Ahern, et al., 2014, was followed. This was performed using *Xanthomonas* strain EC-12 and replicated three times. Phages Mija and Mijo have been shown to be useful in the establishment of lysogens.

Nomenclature.

Novel phages of the Xfas500 phage type were given the names XfaMija (Xfas501) and XfaMijo (Xfas502) for mnemonic purposes. Names were checked for uniqueness by literature searching and were prefixed with Xfa, which is the ReBase species acronym for *X. fastidiosa*. Phages XfaMija and XfaMijo were deposited in the ATCC under accession numbers ATCC PTA-122743 and ATCC PTA-122742, respectively. For simplicity, the phage names may be used without the Xfa prefix.

Phage Isolation and Characterization.

Figure 13:
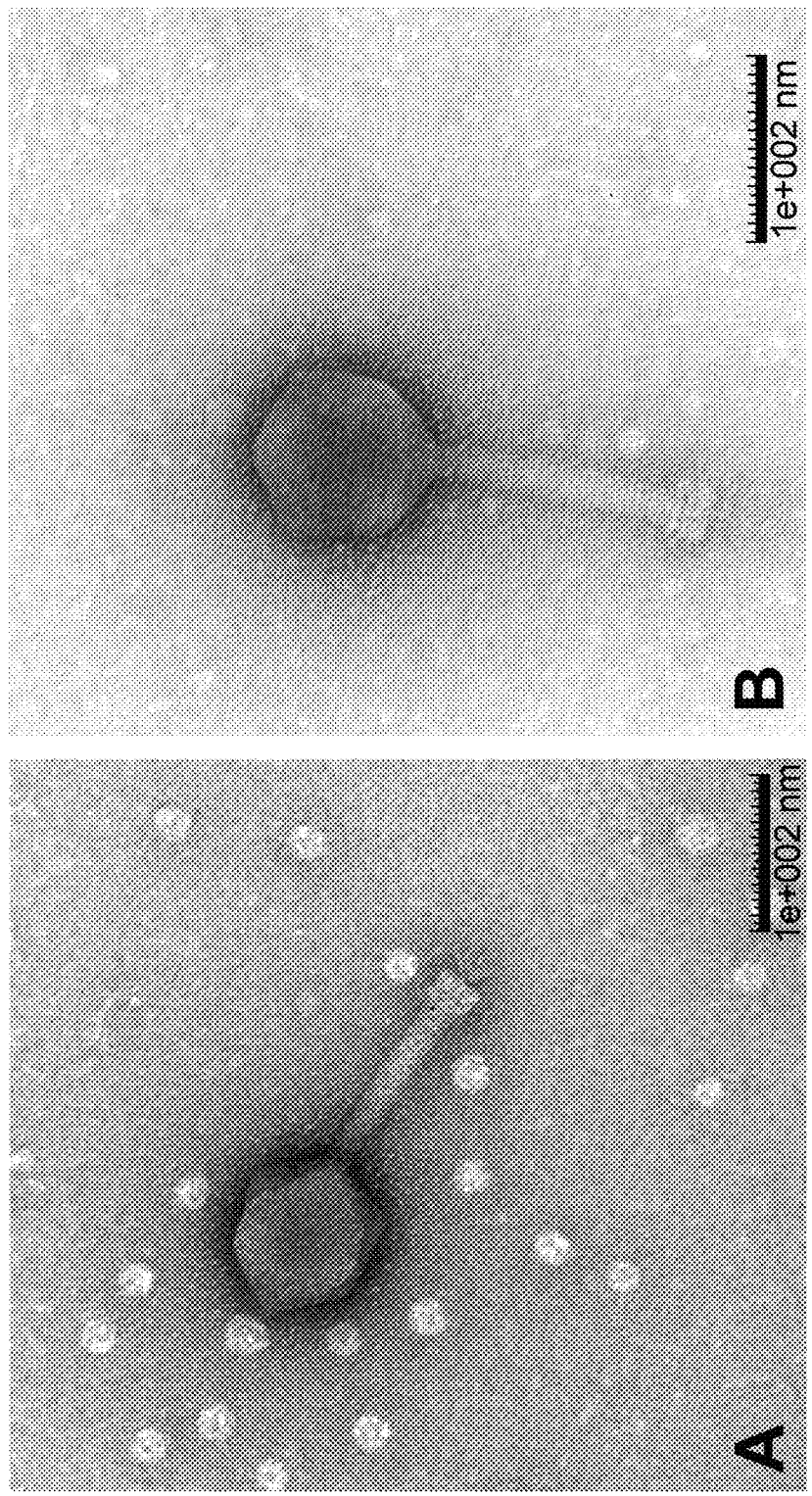
FIG. 13: Shows TEM images of (A) phage XfaMija and (B) phage XfaMijo, with morphology characteristic of Myoviridae.
Figure 14:
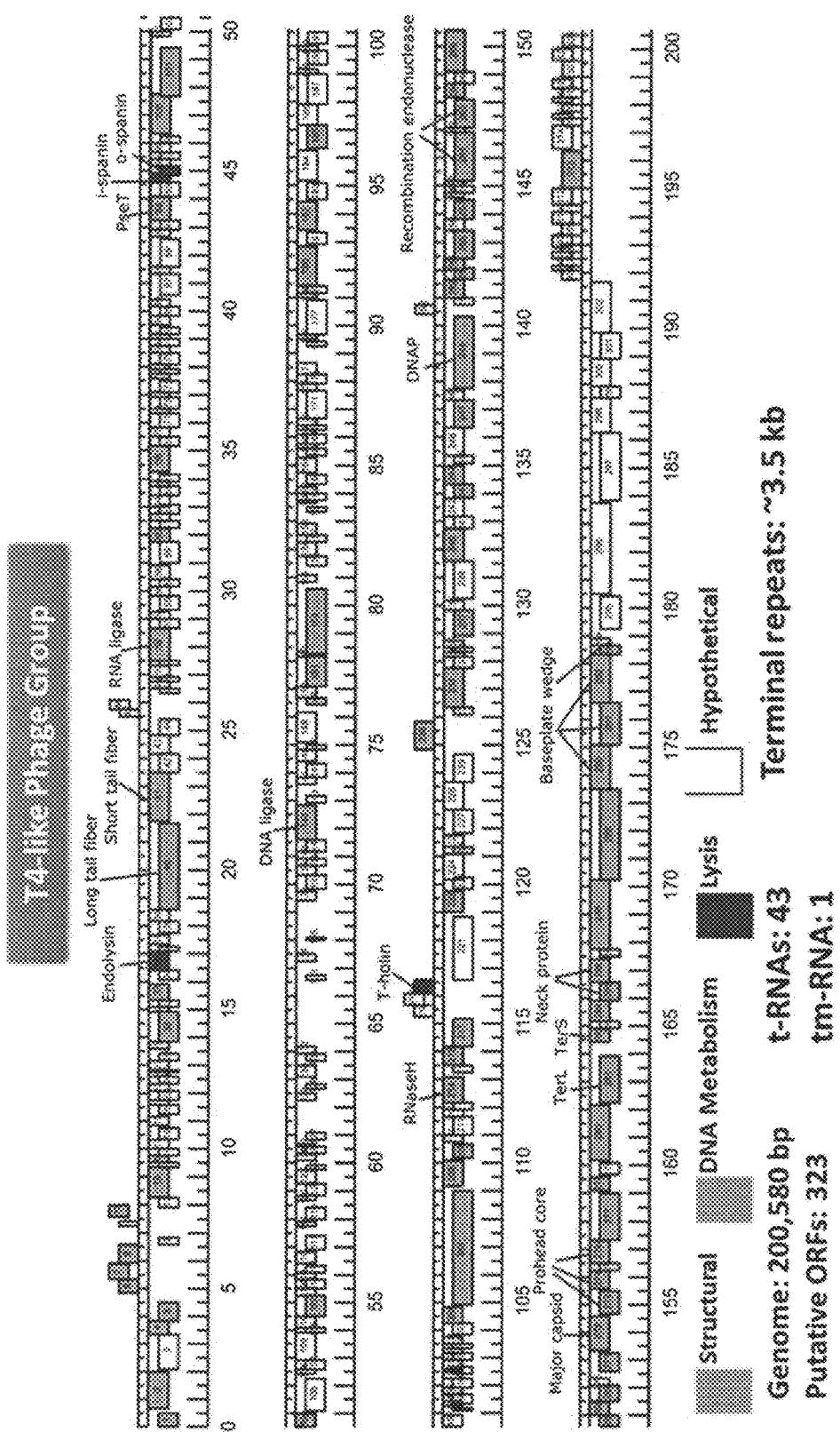
FIG. 14: Shows a genomic map of Myoviridae XfasMija.
Figure 15:
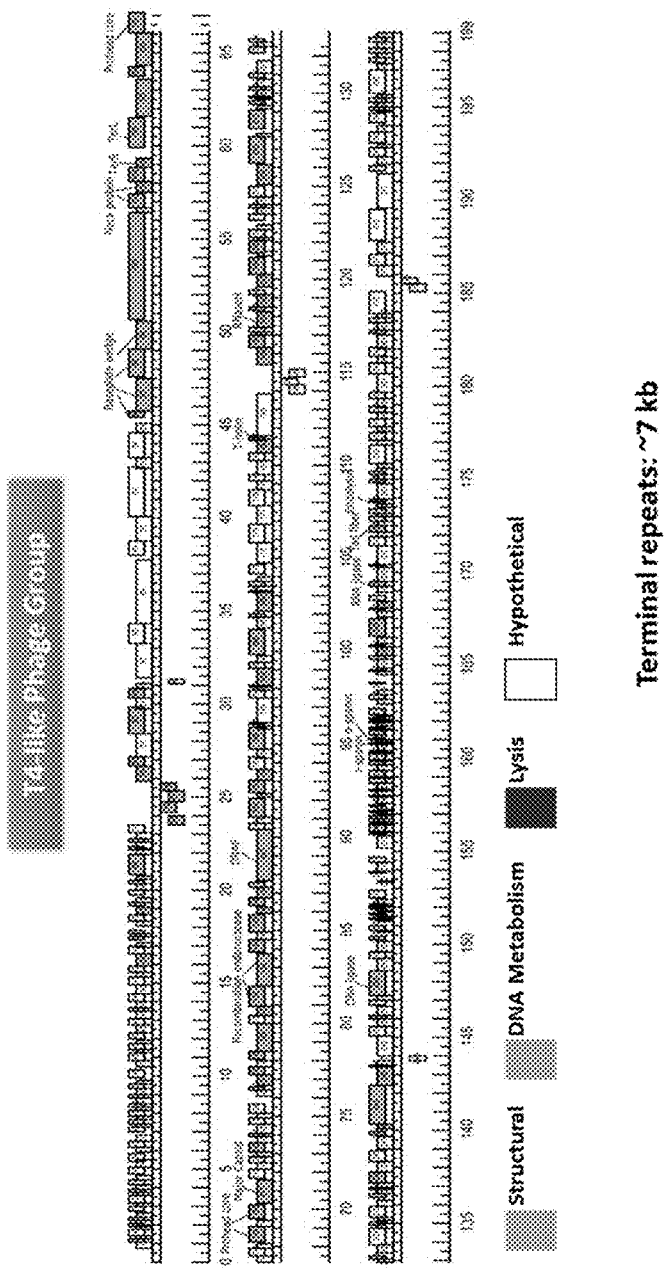
FIG. 15: Shows a genomic map of Myoviridae XfasMijo.

Samples from both plant tissues and ditch, creek or sewage were screened in the laboratory against both *X. fastidiosa* strain Temecula 1 and *Xanthomonas* strain EC-12. Of the phages isolated, Mija and Mijo are representative. Phage Mija was isolated from Duck salad weed (*Heteranthera limosa*) collected from rice fields in El Campo (Wharton County), Texas. Phage Mijo was isolated from water sample collected from a ditch in Weslaco (Hidalgo County), Texas. The physical and host range properties of the two representative phages are summarized in Tables 8, 9, and 10, and FIG. 13. Phages Mija and Mijo exhibit Myophage (Myoviridae) morphology, with isometric heads (average diameter of ~89 nm) and contractile tails (~202 nm) (FIGS. 13A and B, respectively). Both phages formed small clear plaques on both *X. fastidiosa* and *Xanthomonas* hosts, with differences in host range (Table 9). Sensitivity of a collection of 10 Texas and 40 California *X. fastidiosa* isolates representative of 20 SSR typing groups with both phages determined their broad host range activity individually (Table 10). Both phages cannot form plaques on *X. fastidiosa* type IV pilus mutant (Table 9). Phages Mija and Mijo, propagated on *Xanthomonas* strain EC-12, showed a 1- to 2-log reduction in efficiency on *X. fastidiosa* strain Temecula 1 (Table 11).

TABLE 8

General, physiological and structural characteristics of phages Mija and Mijo.

| Feature | Phage Mija | Phage Mijo |
|---|---|---|
| Isolation host | EC-12 | EC-12 |
| Capsid width (nm)[a] | 89 (±2.1) | 89 (±0.8) |
| Tail length (nm)[a] | 202 (±2.3) | 202 (±4.2) |
| Adsorption rate k (ml cell$^{-1}$ min$^{-1}$)[bc] | | |
| Temecula | $(2.13 \pm 0.24) \times 10^{-10}$ | $(1.82 \pm 0.18) \times 10^{-10}$ |
| EC-12 | $(5.68 \pm 0.31) \times 10^{-9}$ | $(1.29 \pm 0.21) \times 10^{-9}$ |
| Burst size (PFU/cell)[d] | 122 (±8.4) | 117 (±6.8) |

[a]Phage physical dimensions are the means of measurements of five virions, bracketed values after each dimension indicate standard deviations.
[b]Phage adsorption rate constants k are the means of three independent experiments, bracketed values indicate standard deviations.
[c]Phage stocks propagated on homologous host.
[d]Phage burst are the means of three independent experiments, bracketed values indicate standard deviations. *Xanthomonas* strain EC-12 was used as host.

TABLE 9

Phage host range.

| Strain | Mija | Mijo |
|---|---|---|
| *X. fastidiosa* | | |
| Temecula 1 | +[a] | + |
| XF15-1 | − | − |
| XF15-1-1 | + | + |
| Ann-1 | + | + |
| Dixon | + | + |
| XF53 | + | + |
| XF54 | + | + |
| XF95 | + | + |
| *Xanthomonas* | | |
| EC-12 | + | + |
| Jal-4 | + | + |
| Presidio-4 | + | − |
| EC-12-1 | − | − |

[a]Ability to form individual plaques.

TABLE 10

Phage sensitivity of *X. fastidiosa* SSR types.

| Isolates | Mija | Mijo | SSR Type |
|---|---|---|---|
| XF134 | + | + | G-1 |
| XF135 | + | + | G-2 |
| XF136 | + | + | G-3 |
| XF137 | + | + | G-2 |
| XF138 | + | + | G-4 |
| XF139 | + | + | G-5 |
| XF140 | + | + | G-6 |
| XF141 | + | + | G-7 |
| XF142 | + | + | G-6 |
| XF143 | + | + | G-8 |
| XF144 | + | − | G-9 |
| XF145 | + | + | G-10 |
| XF146 | + | + | G-11 |
| XF147 | + | + | G-10 |
| XF148 | + | + | G-12 |
| XF149 | + | + | G-2 |
| XF150 | + | + | G-2 |
| XF151 | + | + | G-3 |
| XF152 | + | + | G-13 |
| XF153 | + | + | G-3 |
| XF154 | + | + | G-14 |
| XF155 | + | + | G-15 |
| XF156 | + | + | G-16 |
| XF157 | + | + | G-17 |
| XF158 | + | + | G-18 |
| XF159 | + | + | G-3 |
| XF160 | + | + | G-9 |
| XF161 | + | + | G-19 |
| XF162 | + | + | G-2 |
| XF163 | + | + | G-2 |
| XF164 | + | + | G-5 |
| XF165 | + | + | G-10 |
| XF166 | + | + | G-5 |
| XF167 | + | + | G-8 |
| XF168 | + | + | G-9 |
| XF169 | + | + | G-20 |
| XF170 | + | + | G-20 |
| XF171 | + | + | G-5 |
| XF172 | + | + | G-5 |
| XF173 | + | + | G-20 |

(+) = phage form plaques on isolate using spot dilution series ($10^1$-$10^4$);
(−) = no phage form plaques on isolate

TABLE 11

Influence of production host on efficiency of plating.[a]

| Production host | Indicator host | Mija | Mijo |
|---|---|---|---|
| Temecula | Temecula | 1.0 | 1.0 |
| Temecula | EC-12 | $(9.76 \pm 0.5) \times 10^{-1}$ | $(3.32 \pm 0.3) \times 10^{-2}$ |
| EC-12 | EC-12 | 1.0 | 1.0 |
| EC-12 | Temecula | $(1.07 \pm 0.2) \times 10^{-1}$ | $(2.67 \pm 0.7) \times 10^{-2}$ |

[a] Data shown are the means of triplicate independent experiments ± SD.

Adsorption rate constants for Mija and Mijo on *X. fastidiosa* strain Temecula 1 were on the order of $\sim 2 \times 10^{-10}$ ml cell$^{-1}$ min$^{-1}$, which is 100-fold higher than those for phages previously reported. In contrast, the rate constants for *Xanthomonas* strain EC-12 were ~10-fold higher, at $\sim 3 \times 10^{-10}$ ml cell$^{-1}$ min$^{-1}$. The burst sizes of Mija and Mijo phages were ~122 PFU/cell at 32 min and ~117 PFU/cell at 30 min with *Xanthomonas* strain EC-12 as the host (Table 8). The extremely slow adsorption to *X. fastidiosa* strain Temecula 1 made it unfeasible to determine burst size with this host.

Genomics of Mija and Mijo.

The general characteristics of the phage genomes are summarized in Table 12, and complete annotations with supporting evidence are provided in Table S2 in the supplemental material. The genomes of Mija and Mijo were found to be 200.5 and 198.9 kb, encoding 325 and 360 genes, respectively. Both phages are T4-like with circularly permuted genome. For annotation purposes, due to absence of rIIa or rIIb gene homologs, Mija and Mijo were opened in a transcriptional break upstream to terminase large subunit (TerL). Mija and Mijo have 44.3% and 43.8% nucleotide sequence identity with T4 across the genome, respectively, whereas both phages share 47.3% sequence identity at nucleotide level, as determined by Emboss Stretcher (European Molecular Biology Open Software Suite).

TABLE 12

General features of Mija and Mijo phage genomes.

| Feature | Phage | |
| --- | --- | --- |
| | Mija | Mijo |
| Genome size (bp) | 200,580 | 198,991 |
| GC content (%) | 50.2 | 52 |
| Predicted No. of genes | 325 | 360 |
| Coding density (%) | 91.3 | 91.7 |

SEQUENCE LISTING (30 sequences)

SEQ ID NO: 1 - DNA, 23 bp, Artificial sequence
  Forward primer designed for X. fastidiosa gyr B
gtttgattgatgaacgtggtgag

SEQ ID NO: 2 - DNA, 23 bp, Artificial sequence
  Reverse primer designed for X. fastidiosa gyr B
cattgtttcttggtaggcatcag

SEQ ID NO: 3 - DNA, 20 bp, Artificial sequence
  Forward primer designed for the bacteriophage DNA primase gene
aagaagcgtggtttgtttgc

SEQ ID NO: 4 - DNA, 20 bp, Artificial sequence
  Reverse primer designed for the bacteriophage DNA primase gene
ctaccggcttccctaactcc

SEQ ID NO: 5 - DNA, 18 bp, Artificial sequence
  Primer
aactacctgacagcgact

SEQ ID NO: 6 - DNA, 19 bp, Artificial sequence
  Primer
cgtactagcttggcttcta

SEQ ID NO: 7 - DNA, 18 bp, Artificial sequence
  Primer
aacctgatctggtacgac

SEQ ID NO: 8 - DNA, 20 bp, Artificial sequence
  Primer
ggacatttttcagttctctc

SEQ ID NO: 9 - DNA, 19 bp, Artificial sequence
  Primer
caacctcatctggtatgac

SEQ ID NO: 10 - DNA, 20 bp, Artificial sequence
  Primer
gtcttgggtaatttctttct

SEQ ID NO: 11 - DNA, 56132 bp, Unknown
  Bacteriophage Xfas101
gggcgcagaacggcaagtcgatgaagaagaagaacaagtacggcaagcgcatcaactgcggcttcgacatcatccagcacgtgatgcacgatgatccgctcggcggcgcaatgcgtcccgacgtggacgacgtgctcgacgagctggacgacgatttcgacgacgtggatgtcgacgaggacgaagaggacgaacgccccgcgcgccgttcctccaagaagccgtcgaagtcgagccgtcgttctcgtgacgaggacgaagaggatgaagaggaagaagaggaagagcgtccgcgccgttcctcgtcgaagaagccgtcgaactcccgccgccgttcgcgcgacgaggacgaagacgatgacgacgacatcggcctgtaattcctcgggttgacagtgctacttcggtcgcccggggcttgtccccgggcttccgtttttctgagaccagcgcatgcaaaagcctcaatacgactcgacgctgcaccacgacttcgagaccttcagcgaatgcgacctgaaaaagcacggtctcaaacgctacgccacgcacaggtcgaccgaagtgctgttcctgtggtacgcgttcgacgacgaagagccgcaggtatggttcccgaagacgcagatgatgccgaagcgcctgcgccttgcgttgaagaacccacgtgtcaagaaggccgcgcacaacgcgcagttcgagcgcgccatctggctgcacgtgctggacatcgatattcccgtcgagcagttcgagtgctcgatggcacacgcattctcgctggcgctgcccggcgacctcgatacgctctccaccgtgctgcgcctggacgacaagacggcgaagatgaaggagggcaaggcgctggtgaagttcttctgccagccacgtaagccgaccaagaccaagcagtacacccgcaacaccaagctcaccgatccggtgaagtggcagaagttcctcgactatggccgccgcgacgtgatcgccgagcgcgctgctgcacgcaagatggcccgcttcccgatgagcgcgttcgagcagcgcttgtggactatcgaccagcacatcaacgagcgtggcgtgccgttcgacaaggcatacgtcgaagcggcgctgcgcgtcatctcgaaggagaaggcgcgcctcacgaagatcatgaagcgcatcacgggcctcgaaaacccgactagcggcacgcagctcctaccctggctgcgcgagcgcggctatccgttcaccaatctcaaatccgcctcgatccgcaaggctcgcgaggattgggattggaacatgaccgacgaagcgaacgaagtgctcgcgctgcactccgaggccgcgcgttcgtctgtcaccaagttgcagaagatgctcgacatcgaagtcgacggcatgctgtgctacacgatgcagttcgcaggcgcaggccgcactgcacgctgggctggccgcgcggtgcaggtgcaaaatttgccccgccccctccgagagatggaagagcagtggcagctccttcttttgcgagaagcgatcatggccgaggacatggattgggtccgcatcctcgtgtcgtcgccgatgggcgcaatcgcgtcgtgcatccgcaccgcgatcaaggcaccgaagggcaagatgttcgtcacctgcgatctgtcgtctatcgagtcggtcacgattggctggctggcggattgtcagaagatgatcgaggtgtttcagaagaacctcgaaatctacaaggtgttcgcctcgcgcatgttcggcgtcccctacgagaaggttgagaagtggatgcggcagcaggcgaagcccggcgtgctcggcgcaggtttccgtctctccggcggcggcgaagtgggcgagtacccggaagtcatcaagaccggcctgctgggctacgcagagagcatgggcattgagatgacggcggaggaagcggctgcggtggtagcgttcttccgcagcgagtacgacgaaatcgtgcagctctggtacgacctcgaacgtgctgtcgagaaggtgatgcgcacgaaggagccgcagcgcgtcggcccgattctcatggacgtgaaggggccgttcctgcgcatgcgcctgccgtccggccgctacctgcactacctgcgtccgcagatgtcgtggaaaaagatcaaggtcggcatcgacaagaggaccggcaagccgaagtacaagtcgaagaagggcttcagctacgagggctacggcgggaagagccgcaaggtctggatgcggatcgactcgcacggcggcaagatcgttgagaacttggtgcaggcgattgcacgcgagctgctggctatcggcatcgtgaccgcttgggacaacgggctggacatccgcatgcacgtacacgatgaaatcgtaggcttggtcaaggcgaagctcgcagagattgcagcgcgcgaccttgaagacgacatgaccgtacagccggagtggtggggcgacgaagtgccgatccgcgcgaaggcagaaaccgtggagtgctatcagaaatgagaggcgacatcctatcaaccgacaagcaccgtctcgaaaaagacgtagaagagaagtggtgcaaggtggcgcgcaaggccgggtggaaggcgtacaagttctcttcgcccggcaacagcagcgttcccgaccgcatgttcgtccgcaacggcttcgtgttcttcatcgagttcaagcgccccggcggaaagcctacggcgaaccagatcgaagaacacaaggagctgcgaaagaagggcatggtcgtgctggtgatcgactacttcgacaaagagttcgccgagtgggtgttcgcatgaaggaacgactcgaacgctcgctactggacgactatcaacgcgctgctggcctctttatcgagagtgtcggcagttgtgctttgtgggtcgacatgggcctgggcaagacggtggtcgtgctcacgcacgtgtccgacaaggtgttctccggcgagtggagccgcgtgctggtcgtcgggccgccgctggtggtgtccgacacgtggcctacggaggtcgatagctgggagcacacgcactggctcgactttcaggaactcgacggcacgcctgagcacatgcgcatgcagttggagcggccgtgcgagattgacggcatctcggtgcataagctggatcgtctcgcgtcgctgttcaagaacaacaagaagccggtgccgtgggacgcgattgtgttcgacgaatcgagcatgttccgcaataaggcgtcgaagcgctggaagcacgcggtaaagctcgcgcaccgccccgagactgacgtgatccagctcaccggcacgcctagtccgaacggcctgcatcaagtgtgggcgcagatggcgatcatggacggcggcgagcgtttgttcgcgtcctacagcaagttcctcgcgcacttcttcaacaaggagttcatggggcgcaagatcacgccgaagccgttcgcgctgaagtcgatcaccaagcgcgtcgccgacatcgtgtacacgctgcgggaagaggattacgtcaagctgccgccgctcattcctcgcccggtgccgatcatcctgcctaagaaggtcttggagcagtatcgggagttcgagcgcacgtcggtgctgaagtggggagaggaagaagacccgaacgtccgcgcgctctcggaaggcgcgttgtacggcaagctgcttcagttcgcatgcggccgggtctacaccggagatgatgagaagaccttcatcgacgtgcatgaccgcaagatcgagcgcatgaaggaaatcgtcgagtttagcgacggctcgccgattctcgtggcgcgcacgtggcagcactcgcggctccggctgaaagacgcgttcccgaacatccgctcgctgaagacgaagaaagacatcgacgcctggaatgcgcgtgacatcgaaatcgcagaagtgcatccggcgagcatcggtcacggcgtcaaccttcagcgcggcggcaacaacctgatctggtacgaccacacgccggatttggagctgtacatgcagttgcgaaagcgcctgcaccgccgaggccagcaagcctcacacgtgaacatgatgcacctgaccgcgataggcacgattgaagaagacctgacccgcgagctggtgcgcaaagaagtaacgcaagacgccctgaaagaacccatgcggcgacgtgtcgccgacgtacagagagaactgaaaaatgtccgcagctaaaatcgactacgaagaagagttcttcaacggcatgacgatcccgcgcctcgcgcagttgttccgcctggaccgccgcaccgtcaccgagaagttgcgcccgctgcgtccgaccggcgaccgccgtggcgcgcccacctaccacgtgtcggccgccgcgccgtacctcgtggagcctatcgtcgacatcgccaagtaccttgcggaagtcggccctggcgatttgccgtccgcgttgcaggcgcagtattggaacgcgcagaacagcaagttgaagtacaaggagaacgccggtgacctgtggcgcacgcagcaggtcatggagattttcgtcggcgctttccgctcgctgtcgcagacgttgcgcctgctggcggatcgcgttgaggcacgcaccgacctgacgccggaacagcgcaagatcatcgagcgcgaaatctccgatgtcgcgttgacgacgctgcgccagcgccttgtggaagacttcgagatgtacgcaggcttcaaggacaaggagcagctcgccgacatcaaggtcgacgacatcggactggacgaggatgagtgatatggatgacctgttttcgtctgcacagctttcccagggcgcgcagagcaccttcaacgacctgggcgaactgctgacctacgctgcgaactcggtgctgctcccgcccgagcgtttgaccgtatcgcaggcagcgtcgaagtaccgctacctcgacaacgaaggatcgtacgtcggcccctggctcaatgaagagacgccgtaccttgtcgagccgatggacgtgctcaacagccgcgattttgagtcgtgcatcttcatcggccctgcgcagggcggcaagaccgaaatcatcttgaactggatcgcgtacacggcgcgctgcgacccggccgacttcttcttgatccagaccgcgcgcgacacggcgcgagatttctcgtaccgccgtatcgacaagatgcaccgcgacagccgcgagattggcgcactgctgcgtcccggcaatgacaacgacaacatcttcgacaagttctaccgcaacggcatgatgctcacgctgggctggccgacgatcaaccagctctcgggcaagccggtgccgcgtgttgcgctcaccgactacgaccgcatgccgcaggacatcgagaagaacggcccgccgttcccgctggcccgtaagcgcaccacgacgttcggctcgttcggcatgacgctggccgagtcgtcgccgtcgttcgacgtgaaagacccgaagtggaagccgccgcgcccggactcgcacatgttcccgccgactgacggcattggcggcctgtacaacgaaggcgaccgccgctgcttctactggcagtgcccgcactgcggcgagtggttcgagccgaagttctcgctgctgcgctgggacacgaagaaccccgatccgtttgcggcttccgagtcgaccgtcatggcgtgcccgaagaacggctgcgtgatcgagccgaagcacaagtacgagatgaaccgacgcggcgtgtggcttcgcgatgggcagagtctcgaccgcgacggcaacaagcagggcgtcggcgcgcgttcgcgcactgcgtcgttctggctgaagggaccggccgcgcgcttcatcacgtggcagaagctcgtcgagcgtatgttgcaggcccagcagacgttcgagctgaccgctgaaacgaaggcgctgaaggccacgatcaacaccgaccagggcgaaccgttctggccgttcaacgctaccgactcgaaccgcctgccggaagacctgcaatcgaacgcgatcaagtgggccgagaagaaggtgccgtacggcgctcgcttcctgctcgccaccgtcgacgttcagaagaacatgttcgtcgtgaccgtacacggcatcggcccgagcgagagcggcgcgggctacgacgtgtacatggtggaccgcttcaacatccagaagtcgaagcgcaaggacgacgcaggcgatacgttgtgggtcaagccgtacgcggtgcaggaagattgggacttgattacagagcaggtcgtcgagaaggagtacgagctggaagacggcagcggcttcatgtcgatcaagatgacaggcatcgactccggcggtaagtcaggctccacgacgcgcgcctacaactactggcggtcaatgcgtgatagcgccaagggcaaccgagtgctgctcatcaagggcgagccgaagttcggtgccccgcgcgccgagattgactaccccgactcggatcgaaaggatcgctcggccggtgcgcgcggcgaggtgccggtgctgttcttgaactcgaacgtgctgaaggacacgttgctcggcatgctcgacgcgaagaaggacggcggtgctcgctacttcttcaacaagtggacgccggactatgtgtacgtcgagatgacggtggagttccgcgacgacaagaaccgttggttgaacccaggcaagcgacgcaacgaagcatgggatttggcgtactactgcctcggcctctgcaccattctgaaggtcgagcatttcgattgggacaacccggagagctggtacgacgagtggagtaacaactctcttgtgcgacctgccgatcaggaaaagaggtttgcgtcaagcccgactacggattatggtttcggtcaattcggagccaccctgggatgacgcacaatgaccctcgaacagttgcaagccatgcttgcggaggcacaagcggcctatcacaccgccatgatgggcggcgcggtgacggtcgtggtcgaccagaacggggagcgggttgagtacagccgggccaacccggcatccctgctgaagtacatcgccatgctccaggctcagatcaacgccatgctgggggtcgcagtaatcggcggcccccttcgccctctcttttaaggcggcctagaccatgagccaagacctcgcagtagtacgttctccggagggcgatgccgccttccagcgcacgatgaacgacatgattttcggcggtgccttcgagggcgcgaagaacctcaaccgacagaccgcgttgtggtccgcgccctcgctgccgccggacatggaaatcacgccggacaaagtgcgcatggatgcgcgcacccgcgatctgattcgcaacgacggctacatccagggcgcgctcgacacgagcaaggactccatcgtcggcggccagtaccttttgaacgctcggcccgactggcgctcgctcggcttcgacgaaaagtgggccgaagagttccagctcatcgccgagcgcaagttcatgctgtacgccgagtcgccgatgaactggattgacgcctcgcgcaagaacggcctgacgggtctcgtgcgcatggcgctggcccaggcgttcatggcgggcgagacgctggcgacttcggagtacctgaagggcaacggccgtccgtacaagaccgccatcaacatgatcgacccggatcgcctgtcgaatccgaacgacaatagcgacactgcgttcctgcgccgtggcgtggagattgatcgtttcggtgcagcccaggcgtaccacatccgcgacgctcacccgatggaatcctactacgaccgattcggcgcgaagtggacgcgcgttccggcgttcaagccgtggggccgcccgcaggtcatccacatcgccgacatcctgcgccccggtcagacgcgtggtgtttcgcagatggtggcggtgctgaaagaaatgcgcatgacgaaggtctacaaggacatcgttctgcaaaacgcggtggtcaatgcgacctttgctgcggctatcgagtcggagctgccgcgcgagatggtgttcgcgcagctcggctccggcgacatgacgtggttgcagaagtacatgggcgcgctggccgagtacgtgggttcttccgacaacctcgctatcgacggcgtgcgtatcccgcatttgttcccgggcacgaagctcaacctgcaaaacgccggtcagccgggcggcgtcggcagtgacttcgaggactcgctgctgcggcacatctgcgcggcgctgggcctgagctacgagcagttctcgaaggactactcgaagacgaactactcgtcggctcgtgcgtctatgatcgagacgtggaagttcatgcagtcgcgcaagaagctcatcaccgaccgcttcgcgacgatgatctacatgctgtggctggaagaggaaatcaaccgcccggagaccgatctgccgatgccgaagggtgccgcgcatttctacgagggcatcaatcgcgaggcgtacatcaagtgcgactggatcggcgcatcgcgcggccagatcgacgagctgaaggaaacccaggccgccgtgctgcgcatcgcatcgggcctgtcgacgtacgaagacgagctgggcaagctgggcaaggactatcgcgaagtgttcgagcagcacatgcgcgagcagcgcctcatcgagcagaagaagctcaacttcacgatgtcgaccagcaagccgggcacgcagaaggctactgacagcgccgcgaacgatgacgccaaggcggacacggctaccgaaaccgaaacggagaacgacgatgaatgaattgctggcgatgcgcatgtcgatcatggagggcttcaacggccgcccggccctgatcgcaccgcaggagatggagaatatcgcgacgatgttctcgtcgatgatgcttcagcaggccccgccgaccgccgaacagcgcgcggcggctgaagaggcccaggtggtgctcatggagcgtgccttcgacatctcgttcccgcgcgagcgttccaaggcgtttgccttcagcgacggcctcgccttcatcccgatgcgcggcacgctcgtgcatcgtaacggcgactcgtggtacggcacgcgcggctacgacgacattcgtcgcgagttcgacgctgcgatggccgacccggacgtggcgggcatcgtattcgacatccattccggcggcggcatggtctacggcaacttcgagctggccgatcacatccgcagcaagcgcgccgagaagcccaccctgtcggtcgtcaacgcgggcgcgatgtctggcgcgtattcgctgggcagctcggcgaagaagatggtgtcgaccccctccggcgattccggcagcatcggcgtcgtcaccatgcacgtcgatctgagcaaggcgatggagaagttcggcgtcgccatttcgctgatccactccggcgaacacaaggtcgacggaaacccctatagtccgcttcccgacaacgtgcgcgccgacatgcaggtgcgcctggacgggatgtggcagaagttcatttccgtggttgcagctaatcgcggaatgtccgaacaagcgattcgtgacacgcaggcccgcgtctatggcgcggacgatgcggtcaaggtcggcttggtcgatgcggtcatgtctccgcaagaggcagtcgcttccttccgggccgaagtcttcggctcttccaccagcgaaaacaggagtcccaccatgagcgataccaagaagcccgacgccaccgtcgaagagcagaagaagaccgacgccaccgtcgagcagcagaagaagaccgaagagaaggtcgaccacgctgccaacgagcgcgctcgtatcgaaggcatcaccacctgcgaagaagcgaagggccgcgaaggtctcgccaaccacttcgccttcaagagcagcatgagcgtcgacgaagccaaggccgcactcgctgcgtcgccgaaggcgtcggcctccaccggcaagtccgcgctcgacgcggcgatggaaaagaccggcggcggcgctgacatctccaataacggcggcgacggcgaagacgaaggcgacaagggcgagaaggccgatggcggtctgctcggtgcctacgcccacgccaccggcaacaagagcgtgctgaaggccgtcaagtaaagaacaccgtcgccagcctagacgggaaaaaccggctacctagtccactcacaggagtacatcgcaatgaccaactttggccccatcgctggcgtctcggtcgacaacagcaacgccaatggcaacatccagctcttcgctggtgagtccgacatcgttaccacccaggtgcagctcgtgaccggcgtcgcctacgtcggcggtcaggtgctcggccgcgtcaccgcctccggcctgttcgccaagcacgatccggcggcgaccgatggttcgcagaacgcaacccacatcctcggctacgacgttccgacgccgaccgctggcaagtgggaaggtgcgtactcgggcggcgtgttcaacgtcgatgccctgaccttcaacgctgcctccaacaccgtgcagaagaagatcgcggtcttcgacggcacgaacatcgtggcgcagcgcctgtacggcaaccccgccccgaactccggcccggtctaaccggcgattcacccgcaatacgtttcgcacataactcaactgaaacaggagaagcacgatggatttgtatagcactgcggaactgcgcaaggtgatcgtcgacagccggccgcccgtgcagtatttcctcgaccgtctgtacaaggagcagatcaacttcacgaccgaagaaatcatgttcgacgagctgcgtctcggccgtcgcatggctccgttcgtggctccgaacttgcagggtcgcgtcctgaagcgttccggcttctacaccaagaccttccgtccggcctacgtcaagccgaaggatgcggtcaccccgggccgcatgctgcgtcgcttggccggtgaaggtctgaccggcgacatgaccccgggccagcgctggcaggccactgtggccgcgtaccagctcgatcagcgcaaccagatttaccgccgcttcgagtggatgggcgcgcaggccgcgctgtacggtcaggtcaccgtgtcgggcgaagactacccgagcgtgaccatcgacttcggtcgtgccgccaaccacaccgtcatcctgtcgggcaccgccgcgtggagcgactacgacaacagcaacccggacgacgacctggaagattgggccgcgcgtatccgtgaagctgaaggcttcgtggtcactcgcgtcacgatgggcagcaccgcctggaaggcgttccgcaagcacccggccatcaaggagctgctggaaacccgtcgcggctcgaagtcggaagccgagaccggcccgggcctgggcgagagcgtggagtacaagggccagatcggcgcgttcaacatctacgtgtacagcgatgtgtacgaagacgagaccggcaccatgcagccgatgatggacccgcgcgacgtgctgctggaagctgaaggtggcttcgacggcgtgcgtgccttcggcgcgatcatggatgccgacgccggtttgcaggcgctcgacatcttcccgaagatgtggaagaacccggacccgtccgtgatctacctgctgtcgcagtccgcgccgctcatgatcccgagccgtccgaactgcaccctgcgcgcacgcgtcgtcgcgtaaggccgtttcaccagcaacgcccggttcgccgggccgcgctgtttacaccacccaatcaaccccgcaacaggagatgtagaaatggctgacgacaagaagaccaccaaggctgcggccgctggcaagaagctggtcgctcgcgtggcgctgaagggcgacttcgatgccctggatggcctgggcaccgcgatgcaggaaatccaggcgggccaggagttcaccaccgaagacgccaagttgcagaagcagctcgtcgacaacggctacgccaagtcggcgaaggacgcggcgaaggaagaagacgaggctccggccagctctggctccgccccgccgaaggtcgagacgaccgacaagaacgacggcaagaagcagcagtaatcgcgcctgggcgctaggagacggaacatgggctggcttgaaatcaaacaacgcgcgcgtgatgtgacgcacaagacgttcggtatcccagccctgttccgttcggcgggcggcgtgtctacggacacgtccgctcgtttgcactacaaggtgcgcacgtacggcgacctcgaccgcgaaggcttcgcgacgaccgtcgacgatgtggactacgttgtgatcgacactcgcgagctgctggcaaacggcatcgtcgcagaagagggcaaccggattaatttcccgcagctcaacaggactttcaaactcgacgtggagcatccttccgaggacagtcgctacgtcaagtgggcagtaacggagaccgctccatgaccatcggcctgaccatcaacggactcgacgacgtgcgcaagatggtgagcggcataccggaaacggtcgaccgcgcatcggctgttgcgatcaacgaagcgatcacgttcggtcaggccgagagcagccgtcgcattcgcgagcaggttgcgttcaaggcgagctacatcggcaacgcgaccgatccgggcgcgagactgcgtgtagcgaagaaggcccgcgtaggcgacctcgtaggcgtcatctccggtcgtcaccggccgacctctctggctcagttcgagcagggcgcgaagctcggcaaaggcggctacgttcgagtcaaggtttccgcgaccggcggatcgaagcgcatccccggcgcatttccgatcaagctgcggcgcggcaacggcgtgtacgacgccgagaactcgaacgaaggtattgcggtgcggctcaacaagcagggagagctgcccggcggcttgaacaagaagcaggcggtcaacgtgagcggaagcctctacctgttgtatggtccgtccgtcgatcaagtatttcgtgatgttcggttcgatgtgcaaggcccggtgggtgacgcactcgaatcgagcttcctccgcaacttcgggagattgaaccgtggctgatacgaagcgactgttgctggtcaagacgctctgcgattacctgaagagcgaaatcaccctggcgaacggctacaacttcgacctcgcgatggttcgtcgtgacaagcgcaacttcggcaaggagatgaagctgccgggcgtggcggtgctggaaaacttcaaccccgaccgcttgccggaaactatcggcgggttcgtcgggcagaagcacaagtacgatcagatttacctgctcaacggctgggctgacaactcaggactggccgagggcgacgatgagacggatgcggcacatctgctcatgggcgacgtaaaaaaggcgctggggaagttgattaccccgcgcaaccaagacgggttcttcggtggtctcgcaaacacgctgtccatcgaacccggggttgttcggcctcccgacgagcaatccgacaaagcgtacttctggatgagggtccgaatggaactcgtcgagaaggtgggagacccgtactggattcgtgattaacccctgcaacaccacccgaaggagaccacaatgggcagcgagaattacacccttggccgtggcgaactgcgtttcgacaagttcgtaccgggcacccgcaacaagaccggcgagcgttacctgggcaacaccccggaactgaacctcaccaccgagagcgaaaacctcgatcacttcaacagtgaccggggcattcgcacgaaggacaagagcatcgttctggaaaagaccgacagcggcaccttcatcgccgacgaaatcagcgatgacaacgtggccctgtggttcctgggcgacgtgagcgtcgtggcgcaggcggccctcaccgcgcaggtccaggtggttccggccaaccgcgtcaagccgggcacctacatccagatcggcgagtcgctggcgaacccgaccggcgtgcgcaacgtgaccatcaccagcgtcaccgatggcgcgggcacccccgtcccgtacacgctcaacgaggactacaccgtcgactccgagctgggccagctctacgtggtcccgggcggcgctatcgacggcaccgaggcgttcaccatcaactacagcgcggccgcctcgacccgctcgcaggtcgtggtcggcgacggcaccaccgtggaaggcgcgctgcgcttcgtctcctacaacccgaccggcccgcgccgcgactacctgtggccctacgtgcagctccgcgcggacggcgatctggccctgaagggcgacgaatggcagcagctcagcttcgcgttcgacatcctgaagctggacggctacgctaccgtctacatcgacggccgtccccaggtggcgtaaccggggcgcgtcaaacgcggtcaaggccaacttagtcaagaccaagaaggccaagaccaacttcgacaggccgctctccgaaagggggcggcctgttttcttgccagcaaccgaggaagccaatgtccctttcgtcccttcgccttcgcaccatcaccgtcccgtacctgggcgcggatgacgagcagcagagcatcgtgctgttcggcctcaacgccaacgacgtggccggaatcatcatcgcgcagaaagacaacatggaagaaatcttcgacatcgttgaaggtgccggtgtcaagaaagccaccgacctcgctgaagtcgacatgatgcagatcggccagaagctcatggtgcagatgccggacttcatcgcacgcgttatcgcgtacgccgcgcacgagccggaagcgtggatggtcgccatgcagctcgacgcgccgacgcagatcaagtgcatgcgcgccatcgccgaacttaccttcaaggacgaggccggattccgcgagttcctgggaaacgtccaagcggcacttcgcggagcaaaaagcgtggtgccgcacctgcgaaacaaaaatctcgaatcgagcgattcgcagggtggtggctcggaatccgagcagcagtctccttcctgaccgctgaaggacacgctctcgcaggcgagtatccgctgggtgtgttgatcgtagaaacggaactcgcgcgcgagcgtgtcaacaaccgcattagaactgaagcggttttgattcaaagcgcaatcggctccgcgctcagcaagaagggcgcgcaggcattcaaggaacaaatctcggagctataggcgatggccgctcagaacgaagttgaactgatcgtacgtgcgaagaacctcagtacgaaaaccatttctcagctcaatgacgagctgggcaaagtcgccgaaaaccaaaacgaagtagccgatgcgaaccgtctcgccgagcggtcgttcgagagtctgaagggcgagcagcagaagttgctcgctatcatgaagtcgctcaacgaccgctcgcgcaagctggaaggctacgctcagcaagagcagcaggtgcgcagcctccgcgaagaactcgcgcgtgctcgcgaaaacctcaacacgctcgcgcagcagtattacaacaccgagaagccgacgaaggagttcacccagcagttgaaggccgctggcagtgaagtcactcgcctggacgcgtcgctgcggaataacgagcgccgcctggaaacgtcgggcgcgaagctgaaggagatgggcgtcgacacgacccgcttcagccagtcgcagcaggaactcaacagtgcggtcaacaactcgctggcgctgtaccggcagtcgaccgacaacatggagcgctacgacaccgctgtccgcgaagtgcggcagcagcaggaactcgcgcagcaggaagaacggcagcaggcgcaggccgcccgcgattcggccgctgctgttgcccaggccgcgaaggaccgcgaagagcaggcccggaaggagcagcgcttcgtcgagctgaccaccaacgtctaccgcaccctggcccgcgagaaggagaaggcggcggccgccggggcgaacttccgcgccaccggcacgcaggctgcgcaggcggcccgcgctaccgccgcccctgccgtgggtagcgggtcgaccctgggcggggcagcagcgggcgtacaggcggtgctggaaccggccaagcaggcggtcgctacgctcgaccagctcgaaaaggccgtcgaccagctcgacaaggagttcgaggccctgacgccggacgccctgaaggccgctgacggcatcgagaagctggccgaccagagccgccgcctgcgggaagcggccgccgcgctgaagggccaaggcggtctcgccgatgacctcgcgcggcagaacacggccttgaccgccagccagcagcggttcgaggaagcgcgccaggaagtgctgcgctacgccgaagccgtggagcgatcggatcgcccgaacgacgagctggcggcgtcgctgcaacgcgcacaggccgcactgcggcaggcccaggcagacctgggtcgacagaccgaagcgttcaaccgcgtgcagcagcgtgcggcggccgcaggcatcaccctggaaaacctcaacggcatcgagcagcgcctcgctcagaacgccactcgcgttgcgaacggccagaagcaggtcgcgcagacgatgacgcagttggagcagtcgaccgcgaagaccagcaagcagctcaacgcgctcaacaccgggcagcgcaccgcgctgtcgctgtatcagcgtacccgtggtcaggtgctctcgctggtgtctgcctacgtgggcgtgttcggcgcgatcaatctggtgaaccaaagcgtcgacgccgccgtggatcgcgagcgcgcaatgtcgcgtctcatgatcgcaaacaagggcgacgccaacgcggcggcgaaggaatacgactatctgcgcaagaaggctgacgagctgggcctcgccttcggcccgttggcggattcgtacagccggttctcggttgctgcgcgcgatgccggtatgtcggcggaagcaacgcgttatatcttcgagtcgttcacggaagcggcgacggtcctgcgcctgagtggcgaagagactgagggcgcgttccgcgccttggagcagattttctcgaagggctacatccaggcagaagagcttcgcggccagctcggcgaccgcatgaccggcgcgttcaatttgttcgcgaaggctatcggcgtgtcgacgcaagagctgaataagatgctcgaaaagggcggcgaggttaaggcggagttcgtgctgctggcggcgcaaactgcgcgcggtatttatggtccgcaggccaaggccgcatcgaacagcttgctcggcgacattaaccgcatgtcgaacgcgtggggcgatctgaagcgtgaaatcatcgacggcggcctcggtactgcgctgcgcagcctgttcgtcgatctgacgaagttcctgaagagcgacgacggtaagaagttcgctgcgaatctgacgaaggtcttcgtcgcggccgctgaagcgggcaaggagctgatcgacgtattcgccgagtacgacggcctgatcgagaccgtagcgaacaccgtcgccttcctcgtgcggaacttcaaggagctgatcgcgatcatgctggcgatccaggcagcgcgcatcgccatcgtcttcactcagctcgctacggaaatcctgaaggcccgtgcagccacggtcgcgctcaacacggcgctcggtgcgggcacggccgcgtctgccggtcgcgcaggcgcttcgctgctggcgctgatcggcggccccatcgcggcgctgctggcaatcgcttcggcgggcgtcatcatcccgatctatttccagatgaagggcgagctgaagtcgaacaacgacaagctcgatgtgcagaagaccgtcacggaactcaaccgtggttttgcggcgtccgagcgaaacctcgcagttctgtcgcgcgacaacaccgagcagttggaaaagcgcgtgcaggcagcgcagcgcttgctcacgatctacgatgagcagaagaagaacctcgccgatcagatcgcgcagaacacgaccatccgcaagaatcaggtcgcgattcgcactgcgcagagcactcgggaaggcgacgccaatctgccgtcgaagcagttcgaggctatccggcaggtcgaggccgagggcaaggcgatggaggcgcagctcgccaacctcgaacgccgtgcggccccgctgcgcgagctggtcgcatcggccagccgtgacctcggcatcgcgaagtcgaaggcggccgcgaccgagaacgatgcgctgtcggccgagttcaagcgcatccaggccgaggcggacgcagcggcaaagcgtgcgggcacggacaccaaggcagcgaaggcggccgaagcggcgcgcaagaagaaggaggccgaagagaagcgcctcgccgccctggccgagcgccgtgtgcgcctggaagaagacgtggccgagaagctgcgcgacatcgacagcgacatcgcccaggcgcgcccggatacgctggaagaccggctgaaggtgatcgacaacaagatcgctgatcgcaaggcagagttggagcgcatgatccgcgaggcggaaaagctaaacgtgcccgatgcgaagaaggaagcgcagcgcggcctggacgcactgccggacctcgaaaagcagcagaagcagttggccgagcaggagttctacgaggctcgcatcaacaccctgttgcagcagcgcagcacgtccatcgacacgatcaacaccttgcaggaagccggtctgctgacggcaagcgaagcgtccgcgcagatggaagaggtcaacgctcgtctgctgccgcagctcgaagctctgcgactgaaggcggtcgagttcatggctacgctgggcgatggcccacaggcccaggctgctcgcgcgaacctcgaaaacctcaatgcgcagatcaaggcgatgtcggtcgagatgtcggcgactaagcggaagatcgtcgacgtgttcaccaacggcttcacgaacgccttcatggagagcgcggcggtgatgtccgactacctgaagggcatccagagtgcgggcgacgcatggaagagcttcggcgacatcgtgctcaacaccatcgccgacattctcgtgcagctcgcgcagatgattatccagcaggccatcttcaacgcgctgaagcaggcttcggagagcgcgagcggcggctggggcgcgatcatcaacgcggcgatgagctacgtgaagcatgacggcggtgtggtcggcgcggcgtcgaagaagcgtgcggtgccgagctacgtctacgagagcgcggtgcgctaccacacgggcggcgtggcgggcttcgcggccgacgaagtaccggcggtgctgaagaagaacgaagaggtcttgaccgaaaacgatccgcgccaccgcttcaacggcggcatggctggcggcagcggcccggccccggtagacctgtctatcatcaacaccatcgacagcgagagcgtggttgcggccggtgctaacacccgcgctggtcgtcaggcgatcttcaacgtcatcaaggctgaccgagcctccttcaagaaactcctgggcaattaaaggaaccaacatgggacacgcaatcggaactgttacgggcggcagcggcgacgaggcgtactacaaggtactcgctgcgatcaagaccctggctgaagcgaacggatggacgacgctgcgctacgtcaacacaggcacgaaccgcgagctgattttgaactcgaagggcttgtcgggaacggaggacatctacatcggcttccgtacctacttcagcacgagcggcgactactacaatatcctcgtgggcgtgttcaccggcttcgtatcggctaacacgttcgacgctcagccgggcgcgcggctttctggcgtgccgtgccataacaacgccgtcacctacttcatcactgccaacgcccagcgcatcgccggttgcttcaaagtcggcacgccggtctacacgcacttctatgcaggcaagatgttcccgtattcccgccccggcgagttcccctcgccgctggtgtgcgcgggcatgttcgacggcgcagcggcgaagcgattctcggacctcgactacgcgttcccgtatcacggtcgtgagagcggcgcgtcttccccggagcgtccttcgctgctgtggctgcgcgatcaggtaggcacgtggcgtcgcctctcgcatttcccgttctataacggcgcggctggctcgaactcgtggaacggctacaacgcgttggcgaactacagctacttggacacggacgtaagccaccgctccctggtcccggcaggaacgaactaccagccgcagccgatcatcctgtacaccaccacggccagcggcgacacctacgcgggaaatgtcttcggcgagctggacggcgtgtaccagatttccggcttcaacaacaacgtggagaacgtggtgcaggtcggcggcactgcggtggacagcaccggcatgaccgtggctgagcacgtcgatgcagtccttgcggcgggcggccgcgcattcgtgatgctgcaagacgtgggtcgaaccgactggcgcagcttcatcggcttggagatgacctaatgttctacaccggcaatttttcttcgttcgtgacgctgaaggcgtcgatggaagcggcgcttcagaaccacggctgggcgctcaacggcgacggcacgctggaaaagaacggcatgtacgtccgcctcgtggcgaccgacatctaccagatcgcagcgttcgcaggcaccggcagcgccgtcgacccgttccctctgccgggcgcggctccgtacggcgtgaaaatcatgaacttcagcggctcgccgatgaacttcccggcgacctatgacctgcacgtgttcgaggaaaccgatgaggtctacctcgtcatcaattacaacggcgacaagtaccagcagttgtcgttcggcaagtctcgcgtcgatcaggtcggcggcaccggcatgtggctcaccggttcgttccgcagtgacgtggtgcaggcggcaacccatctcgtgtacaccaacgcgtcggatagctacgtcggcttcgggtggagcggcatggggtgtggcttgttccacgaggtatacaacgcgcccctgggctgctcctacatccacactggcctggactcaaccgggtggaagcgcgtagggaccagcgaaggtgatttgatgggcagcggcgatccagttgccgctctgctgcaatcgctgccgtcgcagttcaaccagagcaccgtgctcctgccgttgctcgcggtgcagcgtcgtctctcgaaggggcagactatcgccgcagacctgcaaaacgcgcgcctgtgtcgcaacgacaaccacctgtccggcgaaatcgtgacctacggcaccgaccgctggaaggtgtacccgttccaccgtaagaacgcagcagtgcgcaacggcgtgccgtggtcgaccggcgcggatcacagcggcacgtttgcctacgccattcgctacacggggccgtgacatggcagcacgtatcggacaaatggggagcgcgtttgagcggggcatcgacaacccgatgctcagtgatgacctcaacaaactgactgaagtcgtgtcgatgttcgacagctacgacggcggtcgcttcttgcagggccgctacggtagctggcacgtgcattcgagcaaccaccggggtgtgtcggcgcagcgcaagatgacgagcttcttcgacgactactacaaccgcatcttcatcgtcccggccgccctggatgcgggcaatctgctgtccacgcaggtccggcacatcatcctttggaatgcctacgtcacgccgcagacgttggagtcggccgtgctcggcccgcaggcaggcatttcgatgtctcccccggcgggcgtcagcattccgttcgagatgccgccgctgcgtgagctggatttcaccgttcagatcgaactggcaggcccgccgacgatcagcagctatgcgcgcttcaccgtggaaggcgtcaactacaccgtgccgatcaccggccgccgcatcgttctcttcccgttctctccgaattgggggtctccggtcgacgagacgatcacgcatcgctcgtgggtgctgtcgtcggacgacggtagcgagcagaccggtagcgagtcgggtgaagtgccgcgacgcacgttggagttcaacatcaatctgcggacttctaagcaggcccagcgcgccgagaatctgctgttcgcatggcaggcccgcttcttcggcgtcccgcattggggcgaagagtcgcgtaccgacgcagccgtcgaagcgggctcgctcgttatccccttcaacaccttcggcctgtcgctcgaacccggttcgctggtggcgctgtatctcgacgacgaggtgaacgaaatccgcgaagtgcagcaggtcactgctgacggcgtttcggtcacgaccgggttggagtacgactggcctgccgactcgcgcgtgtatccgtgtttcgttggcctcatgagcgaagagatgtccgagcagcgcgagacttcccgcgttggccgcatggcgatgtcgttcgacttcgagccgagcgtaacgccgggcaacgcggcgatgaacccggacccgatgacctaccgagggcacgagctgtacatcaaggagaccaactggctgtcggcgatgcctttctccttcagcgcggacacgaagcgcgtagacaccggcacaggcaagttcgttgccttcaccacctcgggcttctcgaaaatcagccgccgccataactggacgctgttcgaccgcgctgacattttcgagttccgtcgtttcctcggccgtcgccagggtgttgctcgttcggtctacatgccgagcggcaccgaagatttcacgatggcggcgacgatcctcgacaccgagaactcgctcgtggtggagtcgaacgaatacgcgaagctggtcggtgcgcatcctgctcgccgcgacatcttcatcctgttgaagaatggtcggtatttctgtcgtcgcattacgctggttagcgagttcgacaacctgacccggttgcagctcgacagtgcgctcggcgaagaggtgcggccgcaggatattcgtcggatcagttttttgacgctgtaccgcttccagtctccttccaccacggtgcgctacctgaccgattccaaggccaccgtcgagtcgatgctggtcgccaagatgaccgaggactgatatgtctctggcccaatacgaaagcagcaaagaacaaggctctcgcgtggagctttacctgtttgagagcgacgacggccgttaccgctgggcgtacaccaccgatgcgcgggagcgctcgattggcccgattacttacaggcccgaagcgattaaacgcggcgagctgaagcagaccgcaggcgatgccaacgtcgagagcctggaagtcgtcgtgccgttcgacaaccccgtggcggccgcgcacgtgccgtatctgccgcctcgccctatcaagctgacgatctacgcgtaccagcgcaatgaccccggcgcggaaatcgtgcaggcgttcaccggcttcgtgacgagcttcagccagaagggagctgacgcgacgctgcaatgctcgcagatcatcgacaacctttcgcagacggtgccgtgggtggtgttcaaggtcggttgcgtgtgggcgctgtaccagatcggttgcggcgtcgacaagtcgctgtggcggcgtgatgcgctcatcaccaccgtggacggctacacgctcggctcgcctgagttcgcgtccaagccgaccggctactacaccaacggcttcatcgtcgaccgcgagaccggcgagcagcgtttcatcacggcgcatgacgcagccaccgccacgatcaaggtcgtgtatccgttccaaacggtgcagggcgggcagattctcgacgtgtacgcaggctgcgcacgcacgaaggaagtctgctcgggcaagttcaataacaagatcaactacgtcgggttcgatcacttcccgacctacaacgtcttccagcaggggatcacctaatggcctggatcgcaattatcgtcgcaatcgtcgtcgcaatcgtcggcgagctgctgcggccgaagcagaagttcaacgacccgaacccatcggccgtgggcgacttcaagttccccaccgtggacgcctcgcgcgtcgtaccggtgtggtggggcacctgcaagatgatggggccgaatgtggtgtggttcggcgacctcgaagtcgtgacgctgaagaagaaggtcaagaccggctggttctcgtcgaagaagatcgtcaccgggtacaactactacctgggcgtgcagctcgtgttcggctacggcccggcagacgagttcatcgaactgcgcgtagacgacaaggtggctgaccttgtgcgctcggtgttcaagtacaaggacacgtggctggccggtcaggtcgcgagcaaggagttcgtcggcgacaagtgcgagttctacatctgctcgccgtccattctcgacaacggcgacccgccgagcggcgtagttggcaagtgcgttctgtaccaaggcacgttcacgcagggcacgaacaactacctctccggccagtggaacgaaccggacatgtccgcgttccgcccgttggtgcatatggtcatggagaagtgctacctcggcaacagcgacacgccgccgcccatctcgatcattgctcgccgctgcccgaaccagctcggcctgaccggcggccgccacaacgtcaacggcgacgcgaatatcgcgtgcgcgtcgtatgagttgatgaccaacaacatgtggggcatgaaaatccctgaagacaagatcgacgttgactcgttccgcgcttgcggcaacctgctggctgaagagtcgctgggcatttcgatgctggtgcagtcggccatgctcggcaaagacctcctggccgaagtgctgcgccacgctgacgccgtggtgtacgccgatccggtcaccggcctgtacacgatgacgctggcccgtgagttctcgcaggccgagaaggacgacctgctggttattgacgacagcaatatcctcgaagacagcttcgacttctcgcgcacgtcctgggagatgacgaagaatacgatcatcgttgagtacaccgaccgcgcctcgttcgagaccaagccggtgcagtaccaagacctcgccaacatcgacgtgcgcggcggcatgatcgacgcggagaccttcagctacctcggcttcagcaatgacactgcggcgatgaacaccgctgctcgcgtgtcgaaaatgaaagcgtcgccgctggtctcggcgaagatgtcgctcaaccgcatcggctacaagctgcgtcccggctccggcttctggctgcgcaagccggatcgcggactggcgaacgtgctcatgcgcgtgatcgaaatcagctacggcaccctggacgacccggcgatcaagatcaccgcgatggaggacatcttcgaggtcaacgctgtagcgtacgtgccgccgggtccgggtgattgggttccgccggttactgctctcgcaccgttcgctgcgcagcgcgtgatcgaagccccggcattcggcgctgacgatatgagccgacgctttctcatcacgatgggcgtgcccgcgagcaacggcgtcatcggctacgacgtgtggagcgaccccagcggcgcgtcgaattaccagatcaccaacgtggtcgagggctacacgccgtctgctgttctcttggccggtctgtcgcgcactggcccggaagtcgacaccgcaggcttcaccgtgtcgtcggccatcgggctgaccggtcttgacccaggcaccgatggttcgcgagaggcaggcgagaacctgctgctggtcggcaacgaactcatggcatggaagaacatcgtcgacaacggcaacggcacgttcacgatcaccggggtgtaccgcgctgtgctcgacaccatcccgcaggatcacgctaccggcgcacgcgtgttcttcctgtccgaaggtgcgggcacgaccaacgtcgacggctactcgggcaacgtcacggtcaacacgaagctagctccgaagaacgtgtcgtcgtcgctcgacatcaacctcgcagcagccgtcacggtcacgaccaactcgcgctctctgcggccgctgccgccgggccgaatccgggtcaacgccgcgccggtcggtgctggatcggccttcaccggggacatgatcttgacctgggcgcaccgcaaccgcctggacgggactatcgcctcccaggccgatccgtcacgtacgccggaggaagggacgacctacaacatccgggtctacaccggctcgaacgccctactggcagaagcgcttgcggtctccgacgctgctaccgccgcgaccatccgcctcgcagtagcaggagacatgcgcatcgaaatcgagtcgatgcgggagggcctggcctcgtggtcgaagcaggtggcctacttcagctacactccggccagcggcacgatcacgaacaccatcgcggtcgacgagccggagtacgttcttgacggaggcggcgcgtaatggcccaggtagttgttgcccaacgcatgtggcagcgccgcgacgtagcggcgaactggcaatcgaagaacccggtcctcgcggccggggaaatcggcgtgcagctcggtgcgacttcggacgagaccaagttcaagatcggcgacggcgtgacgccctggaacagcatcggtttcttcgaggggcggctgatcgaaatcggtacgggcggcggctacatccgctggcgctacgtcggtgacgagaactggatcaacctcgtgtcgctcgaatccctgcgcggcccgcaaggcaacgcaggcgcaaccggcgcgaacggcctgagcgcgtatcaggtggcggtggcgaacggattcgccggtacgcaagctgagtggctggcgtcgttgaaaggcgcgaagggtgaccccggtatccaggggccgcccggcatcccatcgcagcgtcgcatccagagaatcactgacaccaccagcggctcggtcatctgcgactggaactcgtacgacgaaatccgagtgacgctcacggccaacacgcagatcaacatggaaggtgctctggacggccagggttgcgttctgttgctgaagcaagacgctgttggcggccgtgcggttaccttcagcaacaatgttcgattcaacaacctcatctcgacctacaacgccacttccacgccgggaaagtctgaccgcatcggtttcgtgtacgacgatgacgacggcttctacgatgtgcaggccgtggtggatggaatctgacgatggccgacgaatacaccccgccgctatcgcccaacatcgtttgggtgttcaagggcaacgagtacaacccgccgctgtcgcccaacatcgagtggattttcggtgctgacgatgacggaggtggcaacgagttgcgcaagtcttcctacatgcttctcttgactatgtgaggttctgaaatgactgttcgagtttattcctcttctgacgcagacgctccggtccttcgcggcaatacgcccggcgacctcatcaacgtgctcgaaaagtgcctcgtcaccggctacggcagcaaggcgggcgcgggctggacgaagccgttcgctggcaccaacgtggccgcattcaagcaaggccctggctccaatggcatgtacctgcgcgtggacgacaccagcaccgccaccagctaccgtaaggcgaaggtcgtcggctacgaggtcatgaccgatgtcaacaccggctcgccgtcgcccttcccgactctcgcgcagaacccgcagggcggcaattggttcacccactacagtagcggctcggtggcgaacccccgcccgtggacgattatcgcagacgagatgttcttctggttgttgctgaccacttacccggagagcggcacgcagtattaccgcgagtgctacgcgttcggcgacatcatcccgttcaagccgggcgacaccacgcacaccatcctgttgcagaacgactcgcccgacagccccaactcttcggagcagtatccgttccagggttacagcatttcttcggcgatgaaccgctaccgcctttcggttgcgcgtgacttcaccaacctgggcggcccgatcacgctcggctggcacaacgatatgaccaagggcaacagcagttggggcaacggtaacctcagctatcctcacggccctgacggcgggctgtacctctctccggtgtgggcgcacaacccgaatgtcggaccctacagtattcgcgggatcatgcccggcatttgggttcactgccactacttcggaatcctgcccgatggcgcgttggtcgaaggccagggcgaactggcagggaaacagttcctccatcgggtgcactaccagaactccgcgttgtttgaaatctccgacacctgggatcggtaaactgaaatgctgctcgccaacctacccctaagctcgccggaaggatcgacttcgtacgcagacgctacaggtcgattttggagcggctacagcgtcgctccgatcatcatcgacggagcggcgcgttttataggcgacggtctgatctacacgaacagcggcggcgatttcctgctcggcacgaaagatttcgacatcgctttcgacatccagactacgagcagtacgctctccaccgttctagactacctgaccggcagcggaagcacgtggcaggtgtatttcagcaccgaggggcgtttgatctggacggcggaaggccccaacgaatcgccggtaatcggtacgacgagcgcggttaacgatggcaactggcacaccgtgctgttccgtcgaagggacggtgtgctgagcgttttggtggacggcgcagtggaagcgtcggtgcctcacgcccgcaactacaactacgcggtcagcacgtttgcaatcggcggtcgtttgtacttgggcttctcgtatattttcaggggcggcattcgcaacgtctacatcaacgtcatcgacccgccgcctgcacccgcacgcctcgccgcgttcattcgccgcagccgcatcggctgggacaaagtaaccaaggttgattcggtcaagaagatcgaggtctatcgcgcgcctccggccagtttgcggaaggtgcagaccaccaagtcgacgcgaggtgtcccgccatggtggggcgctccggggtcgaccaacgtgctgccgacgtacaagctgcgcggccgcgtgatgcagcgagacccggatacgcaagaagacacgccgttgcagaacgtgcgcgtcgctttgttctaccgccgcctgcatacgctgatcgacatccagctctcggatgcgaacggctacgtgcagttcaacaacctcatgcccggcgtccaggcgtactacggaatcgccttcgactcggacggcggcatcatgcagaactcggtactgtgggatcgcctcacgtccgaacccggcccttaattaatcaggagaagcaccatgaccgactcgaagaagctcaccgacgctgacatcgcacgcgcagccaaggcccttgttgtatcccaggcgaaggtgcgcgccattctcgatgtcgaagcgccacgcggcgggtttcaggacgacgggcaggtcacgatcctgttcgagccgcacaagttctcggagtacacgggcggccgcttcgacaagagccacccgcacctgagcaatccggtgtggggcgcggttccctacagcagctacgccagccagcacggcaaactgcaacaggccgtggcgctcgaccgcgacgccgcactgcgcgcaacgagctggggcatcccgcaaatcctgggcaacaactggaagaaagtcggagcggcatcgttgcaggatttcatcaaccgcatgttccgcagcgagggcgcgcagctcgacctcatggtggcgttcatccagagtgacaccgagttgtggaatgctttgaagcgcggcgattgggccaccgtcgcgagaaagtacaacggctcgcagtaccgcaagaaccaatacgacgtgaaacttgcagcagcccatagaaaattcggaggaaactgagatggaaatcaaaccgcgaatcggtgccgacttgtggcacgccatcacccaaggcacgacgctgaaggtgcgtttcattctcgccctgcaaagcctcatcttcggcgcgagtttgctggtccggcccatgcccgccccgacccggtgggcgctgttcgccacgctgccggtctacgcatggtcggcaatgctatggctcagcgggtcgctcatgctgtggcgcgtgctctccacgcggccggtgacgtggctggcttgggcctccaacgtgttcgcgctgttcacttggtttatcatctgcctgtcctatgccgccttcgagggctggcggggcttggttggcacgcacatcctggccctggtcatggctgttttctgcgtgctccgtactgaggcgactcgtagcgatctggaaacagcgtgatggacgttgagctggaagctgcggtcgacaacatgacaggggaattgacggtggatgaaacgaacgcctggaagtgggtggcggcactgctaggaacgctggtgaccggcggcgtcggttgggtcatcaagaggcagcgctcgggccagattctcgacgacaccgagaacgcggccaagactgatttgatcgagcggttgcagaagcggaaccgggagctggaagaacaactcggtgagcttttcaacaaaaccgccgccgggtacaacgaaatcggcgaagccaagcgcgcggccaacatggcgagcatcgaagctgacactgcaaaagccgctgccgcacgcgcatcggaagcagcgtcccacgcgcaaaggatggcgcaggcggccgacgacgtttcagcgaaacgactggtctacatccacgagctgcgtgcgttgctcgtcgccaacaacatcccgttgcccgcgtggccggagggggttctatgagctggttgttgaacacgaggctgggccaggggttgatcctggccgtggtgattctgctctgctggtggggcttcgcctcgcactacgaacagaaggggcgtgacgcatgcaaggccgagggcaacacgcagtacatcaagaccgaggcgaagggccgcgacgtggcccagcaggcggacaaggaagccgcggcggtcgagcagcaggccggacagacgaaggtcgagaccgtcgagaccatccgaaccgtctaccgcgaccggatcgtcaccaagccggtcagccccggtagctgcgtccacccggtcgacccggcggtgcaggccgagctgctggcccgctggaaggacgcgaacgggggtgtgccatgaccgcccgcgccctggtgctggcggccgccctggtggccctgtgcggctgcacgcaggccgttcgcccggcaccgcctaccgtggactgccgacaggccgcctcgacgcccctggaccccctaccggcggctgacgagtgggtggagtgggtgccgcccacccccgaacggcccaacggcctcgcccggctgtccgcacgggccgccgagtgggttgccagtacgctggtagcggtgaagcgggaacgcgccctggcggccgtgcaggagcgttgcctggacgggtacgagaaggcgggggcgatccgccggtagttgacagccccggcggtcggggatagctttagggccgctggtcgcacttcgcgttgcatcggcacctcggtagggaacgcaggaagagaatcggcgctcagcctgcaactggaaaccccggactaaacacccggggttttcttttgcggtcaaggccaagttggtcttgccccggttggtcttgaccgcaaaagaaaggccccgttgctgagacggggccttccgggggtggcgcgactctcgtcggtggccgggtgtcgactgcgtggttctgctgattccggttttcgctatgcgctggtccggctggaagggcaatatcgcttcgacgactcgaccataaggccgcgtgggtcagcgtgtcaagcgtccgtcgatcacctgttccaacttgccgcccaggtgttgcagcgcctccaccatctcgcgccactcgaacatgtgccgcgtgcggaacgtaccgaacgcatacaccgtgatgccgtcccagcggcggccccggatgtcgttgaggctcgctacccgcttccactcgccgcgcgatgcgcctttgatgtcggcgcactgttcggcctgtctgtcgtctccggcgatgatgtagatcatggcttaccccttgaacttctcgacgtgcttcagcattttctcgcgcgtctccttcagtccatcgtcccacgtcttccaagccgccgcgtcgatgtggctcaggatttcgtcgcgggccatgttgctcagcacggtgggcggcagagcgtccagctcccagctcgattcgccaaatcgcttgcggtaattcacgaaacgcgagtccgtggtttttgccgggttcggcggcggcttcaactcttcgatctggtcgtagttcaacgccatgcgcttcaactcgaactcgccgcccaggccgaacaactggaagcgttcgatcaggtcgcgcgtcatgtcgatgccgctcgggtcgtggtcgccgaagtgcaggatcagcacgtccttgtcggcgttgtgttcgatttcccgccgcgcgaaatcacgcacaaccgatgcgctcgggtagccgcgcgccgcgagcagcggcacatcgtaattccagcacacgttttggaacacgccgaccagtgcttccttctcgactacaaggaaaatgcggcggtcctgcgcggcccacgggtcggtgtggtactgcttggcgctggccgtcaggatgtccttcgggttattccaacgcccgcgcgcctcgaacgaacgcgtgcggtcttcgatggcgtcccaatcaaccagaccggcgatgcggccatcgttgacgaggcgggtgatgtacttataggacttctcgttgttcggaatgatgtcgcgggcaacgagctggtagtaaagctggcgcactgtcagcgtgtagccttcgtcctgatagacctcaatgatgccgttgatgcggtcgatcatttcgaggctcttcttcttgaacgtgatttcctgatacatctcgcgcatggcactcggctccggttgttacagcatgatgctcatggaatcgttgaaggtgatcgtgcgctcgtcatcggcacagcgcgtctcttccttcttgatgttcagcgtttcgctgccccgcacgcacacgaagccgtccttagtgacgttgcagaacccggcgctgtggacttcgacctcgacgttggccggtcgaagctcgatggtgacgtgccgcttcatcgccttggcgatttccgagtgggtcaggtgctcggagaagatgaaggggaacgccttgctcacgtccatgtcggcgaacgtggccttcaggatgacgtacttcatacgccgcctcgcttgcggatcgcggtcgcgctgatcgactcgatttcttcagtgaggcgaatctgctcgaccttgtagccgacatcgcgcccgtagtacacgccgttgacgttcggcatcgggaacacgtggaagcagccccggcggtgctgaagcgcggcttcgatacgcgtggtgaccgctacgccgtccagcgggttgctcgggccgttcggcatgaagcgcacgccgatgccgacgtagccttccttcgcgagcacctgctcgaacagcgccgcgtggcctgcgtgccacggctggtagcgaccgatcatgagaccctgggggatcatgaagcggatcgcctcggcgatgtgacccatctcggtcgtgtccgcccaacgttcggtcacgtagtccgcgttctccggcggcacgaacatctcgttggtgtccgggtagcggctctcggcaagggtgttcatgaagacggtcaagtccgctccgaacaccgcgcgaatctccggcgtcggcgcaacgaagtcagacacaaccagaccttcgtgcgtgtcggcaacagcgcgcatgcggtgcgcctgctccatgcggccttccagcgtgaagtcccaattgttcgccgcctcgcgcacggcatcgccgttgacgtgagcggcgttgaggcgcgcggcgagttcccgcgcgaaggtcgacttgcccgagccgggcaggccgcagatcagaatacgcttagccattgtgctgttccttttcgatgcgaagttcttcgcggatttccatgagcagtttgccgagatggttctcgcccttcccgtcgcacacgccccaatacttgtcgccccaccaattgccttcgacgagggttgcgttgccggtcttcagcagcttcgacttcagcggctcggtgccgaacttctggcggagcagctttctcatgacgttgatcttgttctcttcccatccgtcgcgcagcactacgcgcttaccgcgccgcttcgcgcctgcggcgtccggctcgttacggatgcgtcgacgttcgtccatgtcgtcggtctttgcagcctggaacgcgtgctcgaccgtccggtaggagtggccgtcgaaaacgacagcgcacgaccagaagttcgagaggaagcgatacgggcctgcgaagctgccgatggttttcatggtgcctcctagtggatgatcttggccttgccgaacaggatgcgctgcttctggatgtcagtgcgccggatttgttcttcgagcgagacctgcacgttggtcttcatcatcgcgtgcaggtggcgcggctctacgaccttcccggtgacgaacttgtagatggccgagagcagcgacgggttatgcagctcgaagaaactgccggtaagcacccaggggttgtgacggatgctgctggcgatttcgatgagctgcttctcggcctttcgcagatcgagcggcggcgtgatgcccagggtctccatgctgtgcgccacttcgcgcgcaggccgatggacgatcaggaactttgcgccagggaaccgcacgacgagatggtcgaaaaagaacatcgcggccacgtcggagatgaaagccgggccgggcggcatgccgtcaacaaccaggcccagctcgttgatagacgcgcactgctgcaacgggttgtgcagagacgcgcagccgtggccggtgcccgggcggacgaacgcttccatccacgcgctgcgactgcgcggcaggctcagcatgatcgtcaggtcgtggtactcacccatcggcgttctccttcagccgcgcttcgagcaaatcgcgcatggccgatgcgcccttgcccagcggcacgtagaaatggacggtggtgctgtccatcgcatccatgaagaagtgcttctcgtactcgaaccggtgcgagggggtcggatcgccgacaggcagctcttcctgcttgacttcatgcgagtagagctgcggcggcgaggccgggaacaggaggcgctggccgtccaaggggccgccgatgaaatacgcccgcgcgctcatcgctcgcccccgtccccatgcagcacgccgcgctccttgcggtcggccagcttgtcgcggttgcccttcagcaacgccacgtagccgccgctgccgcagtcgaccaggggtgcggtgcgctcggcgaactcgaacgagacgttgaccatctgctgcaatgcctgccgcatttcttccagcttcgcggcggccttggcctcgtcccactgcatgccgtcgcgcatggccttcttgacgacaccctggacgatgcccgcgtgagtgcagagcgccgattgcagatcgaagccactgatccgggcttcgcggtagtgcgcgtcggcgaggcgcgtggctgcgttgcgcaccatgatggcgaacggcggcaggcccttctgctcttcgcacatgcgggcgatgtaccactgcacgtcgcccagctccttccacgccttcgcgtatcggtcggcgcggtagtcgggcttgaccgcttcttcgtcgaacagttcggccagttcgccgacctcgttgccgatgcccagggcgacgtacaggacgcccgcagtgatcgcaacggtgctgagcgtggtcggatacttcgcggtggtctcggtgaactcggcgtagcctgcggccgctgcgtgggcggcgttgacgaaggccagtcggtcttcccgcttcagagaaagagtgctcatgtgggtctctcaggtcagggtgtggggaaagtcggaggcgtactcaatctcgaacaccttcgcgtcgtcgtgcagcaccagcgtcggctcgccgtgcggcggcgggacaaccgcgaagtcgacaccgcgcgtcagctccgtacgcgagcctacgccgtcgactacctgctcgacgaagatgcgcacgtggtcggggcgctcgcgagcggccagtcgctcacgctgcaagatgcgcttggcgaccttgccgccgaacgccttgcgcagcttctcttcgacgctgcccttgtcgcgggtggcgaagatgccggtgcccggcttgcccggcactccgcgcttgtcggcgcgattgtcggtctcgttgtcgcgctgctgcaactcgaacaagcggcgctcgtctgccgcgagctgcttcttgcgccacgggctgagttccttcccctgcgcttcgagctgcttctccttgtcgtacgtgcggaacacgcgacgcaggctgcggttgatattgatgtcggctttcatgagtgtccttgctgcggatatgaaaaagcgacccggccggtattcgacagggccgctcgttgtactactcggtcaaggccgacttagcgaccggcgacgaacttggtctgcttctgcaccttgccgcgcttggtctcacggaacagcacgatggtcgtgttgtcgtcggccatgatgctcgcgtcttccagggcaccggcttcggtgatgaacggaccctgcatgccgcctgccttctgcgtgccgtcttcctgcgcggtcagcagcaggtaggcgaactgcttcgcgcccttcttgccccggcgcacgccggtcttcttcgcagccttcttgcccggcgggcggccgcgcttcggagcatcggcggcgaccttcttcggcgcagccttcttgacggccttcttggcggcgatcagcttcttggcacgcggcttggcagcggccgtgccggtggccttggtcttcttcggtgcggtcttcttggcgggggctttcttcgccgccttcttggttgcttcggtcactgcttcagcggtggcgctcatcgggtatctccattgcgttgttgtcgacaactcgcgggatgcgagcagggttcccttgcgggattcggttactcgcagcccagcgtggagccagggtgcgaggggctgtcttgcaggtattccttgaagtcgcgccagccgtctttgcaggcaaagccccagcggcggacaatcgagccggtcatgaacagcgtccagcacggctcggtgttgttgccgaacagctcgatcatgtgcatgtgcgtcggcggcagcttgcggaagtcgccagcgtggaactgctgggtgtagtcgaagcggttctcgccttcgcgcaagccgctgttcacggtcacgctgccctcgacgtatgtgcggccgtcctgcggcgagaacaggtcgctcatcgccatcacgtacgcgcccatctgcttgttatcgaacgcagggaaccactcgctcgtgtgctcgatgtagcggccttcgagaatgagcgaggcgctggcccacgggtggtcgtgcagagcgcgctcgtcgtcaccgtggacgaacttgtgcaggtacaggttgagccagcggttgcgcgggatcaggtgccagcgggtcaggtagggtcgacgctcgccgccgttgacgccatccagggtgatgacgcggctcggcttgatgaagcgcgcgtactgcttgaacgcggcgacgaacaggaaccagaggccgagcaggcgcagcgcgttgtagaagcgacgcgagactttcggtgcagtcatgggtgcgatcctcgggatgacggggtagttcattcggcgtccagatcgttttcgttggcttcggtcaggccgccggtcggagccggaaccgcacgagtgacgagctgcggcgcgggggcgaagtcgatctggtagcgctgacggaggaacttcagattttcctcgatacgcttctcgaagatttcggccagctcttcgcgggtcagctcgccctcgtggtggccgccctcgccgacgacgcgcagcttgtcttccggttcgccgtgcgtggtgaggttgcggtagttgtgctgatcgaggatcaacttgtcgagcgcgtcgcggactttcggcaggtcttgcatttcgattttcatgttgtctctcggcgtgagaattatggggtgccgtatcgtggcaccggacgccgggtttgcacttcgtcgcgagggggcgcgcttccgtgctaccgggagactggcctcggcccgtctcgttgcagctcgatcttacccggtggggagtccgaagtaaaatcgctactgcggggccactctatcgccagctccggggcttgtcaacacccctccgcgaatccggcggacggctcagccgggccatctttcgctcccctcggaacagccggtcccgcagcatcttttccgtgacgtgcgggcagttgcgttgaatctggtcgaaggtcatctcttcgccgtcgatccggtagagcctgaccgtccccacgcgcggcagttcacccattgcgtgcgccccgtccgtacgtttcgaggtacacacgatgcagctcttcgtgtgcgatggccttgcggaaccccttctggccgaccagggcgtgcgcgaagtcgtgagcactcggttccgggttgccgatgtgctccgtcatgcgcagcgtctcgttgatgtacgcctgcggctcgccttcgacgtagccctcgtccgcgagcaacccgtggatcgcctcacggtacttccggttgcgatgcttctccgcgaccagggctgcgaacagcgtgaggttcgagagaatccagagcgccgtcgccgcgtccatcactcggcctcttcgtcgtcttcgacttcgcggatcagcgacaggtcgtacatgccgtcgccccacttctcggcggccagcgggccagcctgccgcgcgtcctcggcttcgatgtcaccaacgtggcggccgtctttcacgatgcgatatttgggcattgcagttactccggtttgggtgagatgtgcagggtgtcgagaccctgtttgatgcgcttttccacgtgcttgccgaactcgctcgcatcgccgaacaggatgtcgaggtcagggtcggagcactccgctgcgatgccgcgcattacgtcgagcagcatcggcaggtggtgttgcgagctgtagttctggtggatcatcggccacgcgccttgccgcttccaccacgtcttgcgttcgccctcggtcatgccgacgtagatgtcgatcatcgcgcgggccaggaacggcgaccagaagcaggtatcgaccggcgtgatggagtcgccgaactcatcgagcgcgaagtacaccgcgaagatcggcacgccctcaacggtgtagaccggctcatcgagcatgtccttgtacgtcgcgatggtgtagccccggtaaggagccatgtgttcgtagcggcgcttctcgggcggcgggaggggcattggaaagctctcgttgaagtacgggtctgcggtggcggcggcatgcatgcacgcctgcggcgggtcacgtgcggcggcgcgcatggccgcgtagttgcggtcactcatgcgccgcctgcgtctcggatcagcacgacaggctcaccatcggcgtccccgtcaggcaggcatgcggcgagcacgtcggccgcgccctgggcgtcgccgagcacgagcaactggatggcggcgcggatcgcggtttcggtctcgactgctttgcgttcggccgccagcacgtaccccgcaccgtcgcacagctcttcgagcagatgccgcaaccactgtgccgccgtgaggtctttgcggtccaggctcacgccatacttcttcagccctgcctcggcgcgctggcggatgatcgcgatgaggtcgtccgtggtttgcatgtcgctcatggtgtttctcctagtagcggcgcgtcggcgtcttttcgacaacgcggatgtcgtgggcggggaaagaatgctcgccgtcgttctggtcggtgacgtggacccaaccctggtcgaacgtgcagctcttggcgttgcggaagatcagcggcggcgctccgttaaacgtgatgtcgactcgcatcacagaaccctcgtcgtgatgtgcttgcacgcgccttccgtcaggcggtagtcccacatgctcttgtgcttctcgcccgtggccgcgtcgacgatccacgacacgtcggaaacgccgaaacacttcacgcgtgcgatgccgatccgccagtcgtcgccctgcttggcctgataggtgcaagcctggaacagcatcgcgttgctttcgtcggcctcttccttctcctgcttttcgatttccagcatctcgggcgtgatgagcttcagaccagccgccctcacgtcgatattccgaccgtcagacatgcggatgctcacccacgtgccctccatgttgttccacacttcgttgatggtggcgcgctcgcccttcttgatgccgtcgatcttgcgtgccagtgccgtcttccagtcgccgggcgacatgtcgcggacggcttcgacggtgtagcccgaaatgacgctgataggggcacccgccacgttctcaaagctgacccgacctgcgagtccagcgtagtggtcgttcatgtcaaaactccttgtggaaatctttctcggcccggatgagagccgaaaccttggggccgaactttttcggcgtgtcgagcaggatgtcggcggcaccgattgcgacctggggcgagatgaaatagccctggatcggatgcagcacttcgccgaactcgtcgacgatgtagtaggcgacatgcacgcccactccgtcgagcacgatcagcgggccgccgtcgctgcgcacctgctcgctgtgcagctcggcaatgaacacgtcgcggtatggctggatgcgcttgtacttcatgcggccttttccttcaggtggtcgagctgccagcccgcttcgattgcagcgaagagccgcagctcgctcgcgtcctcgtggtcgagcttcagcagcgtcacgaaagcatcgatcatctgcggcgtcattgggcgcttgtcgtagaacctgcggtacgcgctgttcgggtgcatgtcccacacgtcacacaagtcgacgattcgcttgccctcttcccgcaggtgccgacgcatgatgtcgcgcgtggtcttcgggttcttctttaccgtgatcttacggccggtggatggacggaaactcacagcccgatgtcctccgcttcttccttctcgtgttgcttcagccaatgcgtctccggcaggaacgggaacgggccgagccaaccgataacgttgccgtactgcttggcgaacccgtactgatcgtgccaagcgtcgcgacgccacacacagacgcggaactgcttgtagtgcggcgactggcccggccacggttgcaacagcaccgcgtagtagcccatctcgctcgggtcgtcgagcacttccatgtcgttcagcgagagcggcccgtaccacccgtaaatctgagtgtaggtgcgcgacttgtgcagcgtctcgaaccacccgaagcggtcgttgaactcgaagacgtggtacgcgcgtcgcttgctgttgatcgtcgggtagtcgcaaacctgcacgatgtagaaaccggcttcggtcacgtcttccaaggcttcgagttcgagcattacggcagctccacgtttgtgcgcagcgggcggatgcggggcagcgggccgacccaaccgtggacttcaccgcgatgctgctggtcgcttcccaggtagtaccaatggccctcgtaccacacgaggaacgcgtcgacgacgaggttcacgaccttggggtgatctacgcggactgcgtagacccccgtttcagtcggatcgccgatttcttcgtattgcaccttcacgggatgcccgcctttgccgtgtactcgctcaacttgcgcacccagctcacgcgatcctcgatagggatcgacagcagcgaagcatggccgaactccttcagcatctccttcatcacttcgaggcccttatcccggccgaacgtgttcctgaatgcacgcgaggcgtcacgggacatctcaccgatccaaccttccatctgccggatgcgctggtcccgcttctcgacgttggcgaggcgctgctccgcgagggcttcgacttccttcagcgaatccttgaaggcaatcagctcggattcgacctgcacgccgccacggaacagcgtgcggatggcacggatgatgagcgcgcagtcgtcgtacagcacgcccggcggatcgtagtcgcgccaacccggcacacgacggtccagctcgcggccgatgacgcgaatccaacgcaccgcgttctcgccctcattgtgcgtcagcatgtcttcgcggacttcctgcatcaccgcgccgttgtcgttctcgatgtcgatgtagacaaccggcttgacgttgccctcactatcgagcggacgccatttcgcgagccactgtgcatgatcgcggaaagtgtgcttgttgcgaccgtagtggacgccgcccttatgcgtgtccagcgtcaccgtgtgcgtgttgaagtccccctgctgcacgtcgaccaccgtgtagatgtgctcgctgccgacgcgctggtactgctcgccgaccttcggcggcagctcattgccgtggaagggcacgccgtcaagcacctgctgcgtggcgtcgacaacgttcctcggcgcttcggcttcagcgacaaactcagcctcgacaccgctcgcgcgctccgaccgcaggaacgcctgggcgtcgagctggtacgcgtacgggccgacgctgctctgcggcgacagcggagccagggcggtctcgcggtcgacaggggtgaagaggtcagcccacgagcgcgtgctttcccacacacgatcttccggctcgccgtcctgcaagcagtgcatctcgacatgccagtggcgcacgcactgctgcaagccggtcacgcggtagaacttcgtcggctcagtgcggctctgccagtaggagttgatcgagaacgccgggccttcgttgtagttcttcgagtagacacgttggtcgaagctctccatgccgaccttcttggcccacttttcgaggtcgccgatcacgtcgccagtgtcgacgcgcagctcgatgttgacttccttcttgcctgtgcgcgcttcgatgtccagcaggtcgacgcgcagcaggtcgagaatgcccggcgagagcagcatggcttcagcgatggcgtgcgggtcgatgtcgtcgagcacgatatagcgacggtcattgtccttcaggaagtctatgctgccggaaagcatgtggagctgagtgcccgggaacaggtcgcgccccgacgtggctcggaacgccgcttcgctcttgccctgaccgaagctagaagtaaagccgccggagtggaagcccggctgcggcgacggcacgacgccgttgtgcgattggaacatcacgatgtcctggccggtgaacgtgactttggcccactggaacatgcgctcagcctcggccatttgaccgtcatccaggccgatgtggtagccgcgtcggcggtggatagagaagacaatgccctcgtcgttgcaggtagcgatgaggggcagaagcaccggcttcggtgcgttgttggtgaactgcttatcgtacatatcggcggtccttggttgggttaggtggtgcttacgtggcctgcggcttcgcggtcgagttgcaggtcggccatgcccagcaactcttcgtcccaatcgtcaagcgacatccagccgttgacgtgccagtggaggtcgttgagcgtcagcctgggccagaagtagctgtgatccagtttgttctgctcgatgtagcggttgagtgctgcgccccacttctgcgcctcgacctcgcgccacgtcacttcaccctgaccgtggcacagcatgcagatgcggatgtagttgtcgcggagctgcgtggctccctcgcacgccgggcacacctgcttgtcgcggagccagcgggagagcaggcgcatgcgttgccatgcggccagacggattgcagcgagcagtagggtggtggcagcacgcgcgcgagacaaagggggtactcgggcattctgaaaaaccgaaaccctttgggccaacattttgcccttctccaattccatcacggtgtacttgcgcatggccgttactcggtgcgagtgatggtcaggaacgcgaacatggcgtcgttgctggccgtcatgtacgagccgcgttccatcgtgaagcgcttgcttgcgtgctcgggtgcgctgcgcaccttggcgatgccgccggacagcaccgagttcttcgccttgaagaacgattgcgcctgggacgacagcgtggggccgttctctactacgaatcgacgcacgtggcccagcgactcgccgactttgagcttgctgatctggtcgttgagcgagccgggcaggaacaggacgcgcggcttggcgaccttcggcttggcggcggtgctcttccgcttggccgcaagttccttcttgacggtggtcggcatcttgcgcggcttcttgggggcggtcgtgctggtggtgctggcggatgccatcgggcgaatctcctgtgccgtggttggagtaaagggacaggacaaatactactgcgcggccgggggcagttgtcaagcgcccggttctcggtcgtgaccggccgggagctggccgccctgctgcacaaaggtccggctgggtttccgaagcgggagaaaaattgggtccggctgggtctccgaagcgagagcgcgctggctttcgagttcggtttcggcctgccgtggatttttggaacgggctgactttccgaagcgggggctttttctgtaccggaggcatacgtgtacgcggacgcgcgcacgcacctgcacgcacacccgcccgcgctcctgcacaggtcacgcgcctcacctgcgggcgcgtgtcaatgaacgcgcgccgcgcgcggttcgttctcctggccgcgtcgctcatcctgggaagcgctgaacgccgttcagaaaaataattgaaaaaagtatttgcactactgcgcgaggggtgctgtaattcttccaccggcaggcaacaccgccccggcaactaacaaagggaaagcaaccatgaacgcaacgaaccgcaccgccgccattcgcgaagccgccgccctggctgattcgatcatcgaacagcgcacccgccttgccgctggctgggatcagggtatgaagcgcgacgacgaaccgcgctttaccggcgtcaccccgcgcatgcggatggaacgcgacagcgccgccgctttcgcactgtccgcgcagttcgccaccgacgacgtgcgcgaaggcggcgcggttcgcaacgtggttgccaagctggcccacgacatcgctacccctgtcaccgatacggagattcgcgcagccgccgaccgtgctatggcgctggcccgtgacaccctggcgcagcgtcgcccgttcctgggcgtgttcggtgccgccgatgaatccggcatcgccgacgctgcaatggcgaaggtgtgcggttatgcctatctggcgatcatccagaacaacaccgtgagcatcacgacggacgccgacggcatgctcacgaaagcgtgcctcaatcgtgctggcgtgatcctggccgctggcgacgccgttaacgccctggtgcaggcatgagccgccgcagtcgctccgactatgacgcgcacgcgggcctgtccgctgcgcgcagcaccgcaccgcgtccggtgcgcaagcctcgcgcctcgctccccgtgtcgcgcgtcctgggctggctggcgtgggttgtcgtcgccgcagccgcctatcactacgcgccgcgcgtcgcggcccttgtccgggagttcatctaatgcgcgctttccttatctcgctccctggcgtgccggtgttcaccgtccacgccgatgaccgccgcaccgctcgcaattacgccctgggcttgcacggctacaccgtgcgcccgccccgctttatcaccgtcacccccgtctaaggaatcgcacacatgaccatttccctttcccaagcgttcgcacagtggcaggagttagccgccgacattccgaaggatgacggcccggccctggccgaatcgtggaacgactacaccgattcgctttgcaaagacggcgagttgtgcgcgcttcagtatcactacgcgcccgcctatgacgacgacatgcccggcgaaggctcgcgttacgatgaactaagcgatgatcgcgctttcatcctggaacagatgggcgtgaccatgagcgccgagtttgtgccgtttcacgcgtcgcgcaacaaagatgaaaaatcgccgtcgcttaactggcgcgtgacgctgaagaagggcgaccgcgaagtgttgacgacggattacatgcaaggttgcgggcactgcccggcggaacagcgcaacaatttcaacacgccgaccgtcaacccgaaaaccgaaaagcgcgccgccattgcgcaggaatgcgatacggggttcgaggcgaagggcggaatgatgggcggccagttcaagcgcggccgcaagctagagccggaattggtggacgtgttttatagcctcctgtccgactcgcgcgtgttggattgccgcgacttcgccgattgggcgagtgattacggatttgattccgacagcatcaaggcgcgcgctatctatgacgcgtgcatggccgatgcgctgaagatgcgcgccgcgttcggcgataaggcgatgggcgagcttcacgaactgttcgagggcatgtaatcatgagcgacgttatccactcctataccctggaacgcgacggccttacgttccgcgtcgatcactgcgccgacaccgacaacggcgcaccctgggaaaacgaagatggtcacggcaccgtgtccgactggactacgcgcgacaagtcgccgggcgaattggtgttgaacaccgatcacggtagcaaacgcttttatgacttcgccgacgcgtgccgcatcgcgctgcgcgacggctggggcgcgcgtggcgctgaagagggcatgagtaagcgccagattgccgcgctcgccgctcgcgaggattacgaacaccttcgcgcatggtgcaatgacgaatggagctatatcggcgtcgtggtgacgttgctggacatcgaaggcaacgaaacggacgcgacggattcgctgtggggtgtggacgataatggcgactacgcggccaccgttgcgagcgattgcgtggacaacgtgatgcacggcatttcggccatgctgtatggcggcgacggcgcggtgtacatgagcggttcgcgttcgtggagggtgaaggaatgaatatcgacaaccccgcccacggttacctgcgcgacgcgttgcaggccgcttacctggaatacctcaatgcgtttttgacggttgcacgtttcgccgcgcatcacgacattgacgaaaaaaccgcatgggcgattatcgacatgggccgccgtatccacgaggagcgcaccgcatgaacgtcctgtcgcatggcgaacacgtcgcctcaatcaaccgcatgcataaggccgcagacggctacacgccggaaacgccgtggttgctgctgcacaacactggccgcgtcgaccgcttcgcaacgcaacgcgaggcaaaggaagaagcgcgcaagagctacccccgcgttacgttcgaggtgcgctaatgatgactttctcccttgtgttggtgttgatcctgggcggcgagcggcacacgttcgtcatggatagcggcctgaccgcaggcgattgcgtgcaagccctggtagacaaccccggcgcgcctttgcgctgcgaaaaggagtgaccgacatggccgattccctggaacgtctcgccctcgccatgcgtgcgcaggccctcatccaccgcgagcgcggcaggcacaaccgcgcaaaggaattggaggggttcgccttcgccgtggaaacgtgcgccgccctggatagcgccacgttcgcgccaatgccgtttgccgtcatgtgtcacaccctggccgaccgctgcgccgacatcctgcgcaacgatgatgcgcaagtgcgggcgggtcagttcgagcgactgcgcgacgccgaccgcgtggccgtgtctcgcctgcgcgcttatgcgcatggcgtgggcgatgaggcagacgccgcgcccgaactgtttaaggagacgcgcccgtgagcgttcgcattgtcaaaagcccgggccgcgctaacttcccctgggcggtgcagttcaagccgactgaaaattggtcgactgctgcggcctacgccgacaaggggccagcggtggagcacgccgaacggttgcaggcggaatatccgcatctgccggtgcgtgtgcagcactacacgggagggccgcaggcgtgacgccctacacgtattggctgcgcagcactgaccccaaggcgcgcgtattcgtggctgaagggccgcacgaacgcgacacgtcgctagcgctcaccgcgcgccgcctgggcgtcaaggtgtcgacctcgcgcggcgtggccgtgtatggcctggacacgacgccggttgtgcgcgtggtgaaggaggattgacgcatgaccctggaaccactgaccgaaaccgaaaagcgcaaaatcatccgcgcaaacattctggccgatagtctgctgcgccttgtgcagtgggttgcgttcctggcgatcctgggcgcgcttgtcctgccgctggcagtgcaggcgtggcacaaggccggtgcgatcaccgccgccgtggtgcttgccctgggcgtggcctgcgcgtggcacgtcaagccacacggccgcagctacgcggcgcaggtgcgggacatcgaagcccggcacaagccacacgaataaaaccccgcacccccacacccccacgtctgccactgtctagccctcgctcacgcgggggctttttattgcgcgttcgtctgtccctgggcgctcgccctggccgcctacccttgggcgcgcctttccctggtaacgctatggcctgcgcagtgagcacacctgcgcgcccgcatttgcgcatttccgcattgcgcacgtcctgctgactcgctaacggcctgcacctgggcgcacgtcctgctgatttgtggtcgacctgcggcacacccgatagccctgcacctgggcatttcccgcattgcacgcatttaatttattgcatgggcctagaggcgcgtgtgcgcgtgcgtgtgcgcattgcatttatttcccttttattcgcatcaccgcatggccgcgcggcccgcacgcacgcattgcggcggcgcaggagggtaaaagggatagcggcgatgcgagtaaaaaggtacttccggccctggcgcgggcgtcgcggggggcgctgaccccggtgctcgcgcatttttcaattttttcgcatttccgtctcctataaggggccgaaccgcgcgctgcaccgcatttccgggctaggaattaatttattcgcttgtgacagtagtgacactgacgatttgcggtactgtcacaactcggccccccgcgcaaacggttgatttggaagggttttgaggtcgatttgctactgcgagttgggcctttgtgacactgtgacactgaaaccttctcccttaccgggaaagaaaacacgaaaaacggccacaaattagtaccattgctaatatttgagggacaattcgtattcctgcgtgtagcagaaggtactgtcactactgtcactactgtcacaaaataagaggaaaagtaggcaggacaagggtttcggcttgtgacagtaccttgtgacagtgacgcttttttcgccacatcggcccaaattaattcgtcagtgtcacaaggagttaattcccgggcttgtgacagtaccttgcgcgattggaaagaattgccgataattaattcgccggaaattcgtccggcacaccgagaaatgccgatgatcgctgaaaccgacgaaattgagagcacgcgcgctgacttcgaggaagccgtctacaagaaatatttcgtgtcgcagatcagccgcaccctgctgctgaaaaaaggagtggccgacaaggcgaccctgctggaacggaaaaagaaaggcgcgtaccggcggccggaaattgccgcgatgtggttcgggtggaaattgcgcattgaggccaagccggacccggcatggcaggatcgagtcggctaattcggcgcaacgaaaaacccccggggcgacccgggggtttctttttgcctcgctgccggtgtgcgtttattcgacgcgggtgtccggcacgttcgagccgggttcgccagcgcccggcggcagatcgcggcggccttcgtacgcagcggcgtcggtcgtggcttcgtctacggtggcctggggctgctgcacttccgacttggtgctgccgaagaactctccggtctcgtcgatggtgagctgctggcccgagtgcaggctcacttcgatgctgcggcccgggccgagttcgccgacgctgttgccttcgagcttgacggcgagcgccttgttaccgtggacgtacgagagtttgacggtggtggtcattgcgtttctcctgtgccctggattgggcggttgtaggttacatcttgatgcgtgcgagttcgatgaagtcggtgatccaggcttgcaggttcggcttcatcaccagctcgggatgcttcgaccaatagcgcgccagcttgccgctcgcaccgcgcgcccggccaacgtagacgaagcccttggcggtcaggaagttcgacagcttcggcccgaacggaactccgcacgacgcatccagcgccgcgtcgcgcagcctgccgacgttgagcagcatgttgttgacttccgggtcggtgctctcgttgatgatttccagcagctcgtcttcgtcgtcgccgcgagccaggtcgatcatgcgttccttggcgtccgtcatcggcgcgtggccgtccgggtcgaactcgggatgcagcgggtagtcttccagccactcgcgcagcgcgcccgcgtgataggcgatggcgttgaagatgtcgtcgtagtggtcggggtgctgcgcgcggaacttctcgatcatctgcttcgtctggaagtgagtcgagaccacgaagtaccggcggtcggcgtcgtacaccggcagcgcgtcgctgtgattggtcaggatgatcgtggagctgacgttcggcacgttgaagccgccgctgtgcatcttgcggatgtccaccacgtcgttcgtgatgtagggcttcagcttgtccatcacggcgtagcgcgacgtaccggcgatgcgggcttcctcgaacacgacgaccttgttgcgctcgtagaactcggtgtacttctcttccaggcgttgcgcgttgacggtgatgacgttgttcttcgacaggatcgccatgagcatttcgccgacgaaacccttaccggcaccgtcgataccctgcatcaccacggcccagcgaatcttcttgtccatgcgcttgatagtgaacgccagccaggacagcagcagctcgcgctcgcgctggatcgggtaggaaatctcgaagtgacgcttcaccgcctcgaccgcacgccgcgccttgccgcccatcttctcggggatcggcacgatgtcttccgggttgaacaggttgacgtgcttctggtcattccattcaacgattcgctcggcaccgggcaggtacacgtagccgctcacgaccggaacctgatacacgttgagcgccagggccgatgcctgctgctccggcaccgcgtccatgttcgagcgatccttcttcgacagcaggtggcggttgttgcgcgcgttgaacgcacgctcgctcagcgcgacgcggttctccatcaagaagaactcttcctcggtgtcgacgtacaccacgtcgttgcaccagaacggcagctccttgtagttgaagtcggaattgcggtagccctcgttcaccgccttgcgtacggtcgcgatgctcggcgacttgccggtcagctccttgacgcgcttctggatttcgcccaccagcagctcggcctgatagtcgtgctccatcaaccggccccacttcttcgccagcgggccaagaagttccatcgcgctttcggtctcatgtaccttgcgcttgatcttctcgaactgttcctcggcgacctcctgccggtgctccttcgcgatcttgatgagcgatgcggccgtggtgatgttccggcccatctcatcgtggaacgtgttccacttttcttccagcgagtcggcgtcgtattcgctcgacgtttcggaccactcgtgccagagcgacaggccctcttcctcgccgtcgaattgatggtgcagcgccatgccgaccttcaaccactgctcgtagtcgtcagcacccggcacccattgcagcacctcgcggagctgatcggcggtcaggttttcgagcggctgcttgtgcgccagcagtgcgcggtcgttctcgtcgtcgatgtcgtcgcgactcgcatcgcgcggtgcgttgtgcttcttcaacgtccagccgcgacgctgcgcttcgagcttgaagaccgagaacaactcgtcgatggcgtcggtcgtgatttccggcagcatgtcgtgcggcacgctcaccgggttcatgcccttgccggaagtccagcggtacggcttcttcgtctccgggtgcaggccgatgccaacaaactgctggccgtcgcccaggacttcgattgcgtgctcggtaccttcttcgtcgacgaaggtgatcttgcgcttctggaacgggatgtcggtgcggtacacgagcatggtcttcggggccatgccgacacgcgtcatcgtcttgccgcagatttcaagcgcgtgctcggccatcaactcggccatctcggcgtcgtagatgtcgatgtccacggcaggcgtgtgcttcgtcaagaagccgatgttgccctgcgtgtagtcgccgctcgcccacttctttaccagcttcggcgttgcttcaatatgctgccacttcggctcgattgggcctttccgtcccttcggaatcgggatgatggagtagccgttttcgagcaactgcgcgccgtatttgcgaagcacgctggtgatcggtcgtccagccatgtgcgtcactccgcgatgtcgtcgccaacgaggtcttcgagattgaatccaatctcacggttgaagtctttgtgcaagatcgaagccttgtcgcgcggcacgcatccgagacgttgccaacgcgacacggtggtctcgtgccagttgtacttctcgcagattgcgttgagccgaccgtacggcgggtcgagcattagggcgatgcgccggagtagatagcggacgcgcgcgtcggcgctgtccagtgaatcaagggttaggtctcggcgcatggaatcctcgcggcgtgtgggtttcaaggggtctgctaagccgctttgcgtgcctattgacttagcgttgggacgggcgcatagtgcgctcgccgggcaggaattgcaatccgcccgtcactcccaaaaccaacctagctaggagcaacaaaccgatgtccaccatcaacgcgaagaagctcgccgccgccatcgttctcatcatcgaagccgtgggcgggaccagcagcaacagctccgtcaacgaatccgaagacggtggtgacgaagaagaagcgccgaagcgcggtcgcggccgcccggcgggcagcaccaagaaggcaccggccgagaaggccgctccgaagggcaagggcaagtcgaagcccgacccgctggacgacgaagacgaagaagaaggtgacggcgacgaggacgaaggcgacgacgacctcggcctggaagacgacgaagaagaagtgacccaggaagagctggtcgcctccttcaaggcgctgaagtccagccacggcgtcgacgcctgcaagaaggtgctggccctgctcgacgagagcaacgtcctgaacattccggccaagaagtacccggaagcgatgaaggaaatcaagcgcgcggccagccgcaagaagtaattcggcctgcacgtaacacggacgcccggcgatgccgggcgttctttcgagaggacacgatgaagccacgtcgcaacaaactcgcaaaggccgtcaaggaagcagtgcgtgcgcatgcgcgctttgcgccgtcgtctgcacagcgcatcttcgactgcccggccagcttggtgctcaacgagcaggagccggacagcgagaactacgaggcggccgaaggcaccgttgcgcatcacatcggcgagacctgcctgttgaccggcaaagacccggaagagtttctaggaatggtgttcgatagcggcaaccttgatgccgactacgacgaagagcttcattcctcgaaaggcttcgctatcactgttgacgacgagatggttgctggcgtcggtcagtatctcgattacgtgatgcgtctgccggggtgccacttcgttgagcagcgagtgaacatctcgcggtggtgcccgatccccgatcagttcggcacgtgcgaccacgcagcggccatgtacaagaagctggtcgtcaccgacttcaagtacggccgtatcttcgtcgagccggagaacaacttccagctcatcatgtacgcgctcggcttcatcaacgagtgggactggctgtacgacttcgacgaagtggtcatccgcattgcgcagccgcgcgtcgagaacttcagcacgtgggtcacgagcaaggccgagctgctggctatcggcgagaagatcaagaagcgcttcgccctggcgctcagcaagaacccgccgttcggcccgagcgagaaggcgtgccggttctgcaaggtgcagtacaagtgccgcgccaaccacgacttcctctaccaccagcgcgtcatgctgctggacgatgacggggacttcgttgaagacgacctcacgatgatgagcctcgaagagctgtcggcggtgtggctgcgtaagagcatgtacgacaagcgcatgggcgctatcgccgactacctgcacaccaagatcgccaacgacgagtttgtgcccggcctgaaggtggttgcaggcaagaagtcgcgctacttcaccagcgaactcgatgctgaaatgctcatggtcgatgctggcatcaagcccgaaaagctgtactctaagcccgagtttatttcgccccacgccgcagagaagttgctgcgcggcgaggcgaagaagaaattgcaggacttcatcgcatcgaagcccggcaaaccgtgtctggtctccgcagacgacaagcggcaagacctgaccgtgcagaagttgtcgctccttgatgactgacgcacgtagtagttcgacaatcccgacaaccgacaatctcgacagacgatagtctcgacaacgataggagcaacaccgtggctaagaagcaaatcccgcagaacgacctcgtggacaagggcgatggtcgctaccttctgaaaggcgctcgcctttcgttcgcctacctgcacaaccccgatgagcaggaaaacgatgaaggcaagaaaaccaagtcctaccgcaccgcgttgctgatcccgaaggcgaccggcgcacgcaccaagaagaagttggacaaggtgatcgccgacctcatcgccgaagagtacgacggcggcaaggtgggcagcgacaagcgcttcctgcacgacggcgacgacggtgacatcgcagagcacgagggccattgggtcgtcaacgttcgcgagagccgccgcccgacgctggtcgaccgcgaccgtcagccggtgatggaagaagatgaaatgatctattccggcgcgtgggtcaacgctgtgattcgcccct

SEQ ID NO: 12 - DNA, 56132 bp, Unknown
  Bacteriophage Xfas102
gcgcgtcgagaacttcagcacgtgggtcacgagcaaggccgagctgctggctatcggcgagaagatcaagaagcgcttcgccctggcgctcagcaagaacccgccgttcggcccgagcgagaaggcgtgccggttctgcaaggtgcagtacaagtgccgcgccaaccacgacttcctctaccaccagcgcgtcatgctgctggacgatgacggggacttcgttgaagacgacctcacgatgatgagcctcgaagagctgtcggcggtgtggctgcgtaagagcatgtacgacaagcgcatgggcgctatcgccgactacctgcacaccaagatcgccaacgacgagtttgtgcccggcctgaaggtggttgcaggcaagaagtcgcgctacttcaccagcgaactcgatgctgaaatgctcatggtcgatgctggcatcaagcccgaaaagctgtactctaagcccgagtttatttcgccccacgccgcagagaagttgctgcgcggcgaggcgaagaagaaattgcaggacttcatcgcatcgaagcccggcaaaccgtgtctggtctccgcagacgacaagcggcaagacctgaccgtgcagaagttgtcgctccttgatgactgacgcacgtagtagttcgacaatcccgacaaccgacaatctcgacagacgatagtctcgacaacgataggagcaacaccgtggctaagaagcaaatcccgcagaacgacctcgtggacaagggcgatggtcgctaccttctgaaaggcgctcgcctttcgttcgcctacctgcacaaccccgatgagcaggaaaacgatgaaggcaagaaaaccaagtcctaccgcaccgcgttgctgatcccgaaggcgaccggcgcacgcaccaagaagaagttggacaaggtgatcgccgacctcatcgccgaagagtacgacggcggcaaggtgggcagcgacaagcgcttcctgcacgacggcgacgacggtgacatcgcagagcacgagggccattgggtcgtcaacgttcgcgagagccgccgcccgacgctggtcgaccgcgaccgtcagccggtgatggaagaagatgaaatgatctattccggcgcgtgggtcaacgctgtgattcgcccctgggcgcagaacggcaagtcgatgaagaagaagaacaagtacggcaagcgcatcaactgcggcttcgacatcatccagcacgtgatgcacgatgatccgctcggcggcgcaatgcgtcccgacgtggacgacgtgctcgacgagctggacgacgatttcgacgacgtggatgtcgacgaggacgaagaggacgaacgccccgcgcgccgttcctccaagaagccgtcgaagtcgagccgtcgttctcgtgacgaggacgaagaggatgaagaggaagaagaggaagagcgtccgcgccgttcctcgtcgaagaagccgtcgaactcccgccgccgttcgcgcgacgaggacgaagacgatgacgacgacatcggcctgtaattcctcgggttgacagtgctacttcggtcgcccggggcttgtccccgggcttccgtttttctgagaccagcgcatgcaaaagcctcaatacgactcgacgctgcaccacgacttcgagaccttcagcgaatgcgacctgaaaaagcacggtctcaaacgctacgccacgcacaggtcgaccgaagtgctgttcctgtggtacgcgttcgacgacgaagagccgcaggtatggttcccgaagacgcagatgatgccgaagcgcctgcgccttgcgttgaagaacccacgtgtcaagaaggccgcgcacaacgcgcagttcgagcgcgccatctggctgcacgtgctggacatcgatattcccgtcgagcagttcgagtgctcgatggcacacgcattctcgctggcgctgcccggcgacctcgatacgctctccaccgtgctgcgcctggacgacaagacggcgaagatgaaggagggcaaggcgctggtgaagttcttctgccagccacgtaagccgaccaagaccaagcagtacacccgcaacaccaagctcaccgatccggtgaagtggcagaagttcctcgactatggccgccgcgacgtgatcgccgagcgcgctgctgcacgcaagatggcccgcttcccgatgagcgcgttcgagcagcgcttgtggactatcgaccagcacatcaacgagcgtggcgtgccgttcgacaaggcatacgtcgaagcggcgctgcgcgtcatctcgaaggagaaggcgcgcctcacgaagatcatgaagcgcatcacgggcctcgaaaacccgactagcggcacgcagctcctaccctggctgcgcgagcgcggctatccgttcaccaatctcaaatccgcctcgatccgcaaggctcgcgaggattgggattggaacatgaccgacgaagcgaacgaagtgctcgcgctgcactccgaggccgcgcgttcgtctgtcaccaagttgcagaagatgctcgacatcgaagtcgacggcatgctgtgctacacgatgcagttcgcaggcgcaggccgcactgcacgctgggctggccgcgcggtgcaggtgcaaaatttgccccgccccctccgagagatggaagagcagtggcagctccttcttttgcgagaagcgatcatggccgaggacatggattgggtccgcatcctcgtgtcgtcgccgatgggcgcaatcgcgtcgtgcatccgcaccgcgatcaaggcaccgaagggcaagatgttcgtcacctgcgatctgtcgtctatcgagtcggtcacgattggctggctggcggattgtcagaagatgatcgaggtgtttcagaagaacctcgaaatctacaaggtgttcgcctcgcgcatgttcggcgtcccctacgagaaggttgagaagtggatgcggcagcaggcgaagcccggcgtgctcggcgcaggtttccgtctctccggcggcggcgaagtgggcgagtacccggaagtcatcaagaccggcctgctgggctacgcagagagcatgggcattgagatgacggcggaggaagcggctgcggtggtagcgttcttccgcagcgagtacgacgaaatcgtgcagctctggtacgacctcgaacgtgctgtcgagaaggtgatgcgcacgaaggagccgcagcgcgtcggcccgattctcatggacgtgaaggggccgttcctgcgcatgcgcctgccgtccggccgctacctgcactacctgcgtccgcagatgtcgtggaaaaagatcaaggtcggcatcgacaagaggaccggcaagccgaagtacaagtcgaagaagggcttcagctacgagggctacggcgggaagagccgcaaggtctggatgcggatcgactcgcacggcggcaagatcgttgagaacttggtgcaggcgattgcacgcgagctgctggctatcggcatcgtgaccgcttgggacaacgggctggacatccgcatgcacgtacacgatgaaatcgtaggcttggtcaaggcgaagctcgcagagattgcagcgcgcgaccttgaagacgacatgaccgtacagccggagtggtggggcgacgaagtgccgatccgcgcgaaggcagaaaccgtggagtgctatcagaaatgagaggcgacatcctatcaaccgacaagcaccgtctcgaaaaagacgtagaagagaagtggtgcaaggtggcgcgcaaggccgggtggaaggcgtacaagttctcttcgcccggcaacagcagcgttcccgaccgcatgttcgtccgcaacggcttcgtgttcttcatcgagttcaagcgccccggcggaaagcctacggcgaaccagatcgaagaacacaaggagctgcgaaagaagggcatggtcgtgctggtgatcgactacttcgacaaagagttcgccgagtgggtgttcgcatgaaggaacgactcgaacgctcgctactggacgactatcaacgcgctgctggcctctttatcgagagtgtcggcagttgtgctttgtgggtcgacatgggcctgggcaagacggtggtcgtgctcacgcacgtgtccgacaaggtgttctccggcgagtggagccgcgtgctggtcgtcgggccgccgctggtggtgtccgacacgtggcctacggaggtcgatagctgggagcacacgcactggctcgactttcaggaactcgacggcacgcctgagcacatgcgcatgcagttggagcggccgtgcgagattgacggcatctcggtgcataagctggatcgtctcgcgtcgctgttcaagaacaacaagaagccggtgccgtgggacgcgattgtgttcgacgaatcgagcatgttccgcaataaggcgtcgaagcgctggaagcacgcggtaaagctcgcgcaccgccccgagactgacgtgatccagctcaccggcacgcctagtccgaacggcctgcatcaagtgtgggcgcagatggcgatcatggacggcggcgagcgtttgttcgcgtcctacagcaagttcctcgcgcacttcttcaacaaggagttcatggggcgcaagatcacgccgaagccgttcgcgctgaagtcgatcaccaagcgcgtcgccgacatcgtgtacacgctgcgggaagaggattacgtcaagctgccgccgctcattcctcgcccggtgccgatcatcctgcctaagaaggtcttggagcagtatcgggagttcgagcgcacgtcggtgctgaagtggggagaggaagaagacccgaacgtccgcgcgctctcggaaggcgcgttgtacggcaagctgcttcagttcgcatgcggccgggtctacaccggagatgatgagaagaccttcatcgacgtgcatgaccgcaagatcgagcgcatgaaggaaatcgtcgagtttagcgacggctcgccgattctcgtggcgcgcacgtggcagcactcgcggctccggctgaaagacgcgttcccgaacatccgctcgctgaagacgaagaaagacatcgacgcctggaatgcgcgtgacatcgaaatcgcagaagtgcatccggcgagcatcggtcacggcgtcaaccttcagcgcggcggcaacaacctgatctggtacgaccacacgccggatttggagctgtacatgcagttgcgaaagcgcctgcaccgccgaggccagcaagcctcacacgtgaacatgatgcacctgaccgcgataggcacgattgaagaagacctgacccgcgagctggtgcgcaaagaagtaacgcaagacgccctgaaagaacccatgcggcgacgtgtcgccgacgtacagagagaactgaaaaatgtccgcagctaaaatcgactacgaagaagagttcttcaacggcatgacgatcccgcgcctcgcgcagttgttccgcctggaccgccgcaccgtcaccgagaagttgcgcccgctgcgtccgaccggcgaccgccgtggcgcgcccacctaccacgtgtcggccgccgcgccgtacctcgtggagcctatcgtcgacatcgccaagtaccttgcggaagtcggccctggcgatttgccgtccgcgttgcaggcgcagtattggaacgcgcagaacagcaagttgaagtacaaggagaacgccggtgacctgtggcgcacgcagcaggtcatggagattttcgtcggcgctttccgctcgctgtcgcagacgttgcgcctgctggcggatcgcgttgaggcacgcaccgacctgacgccggaacagcgcaagatcatcgagcgcgaaatctccgatgtcgcgttgacgacgctgcgccagcgccttgtggaagacttcgagatgtacgcaggcttcaaggacaaggagcagctcgccgacatcaaggtcgacgacatcggactggacgaggatgagtgatatggatgacctgttttcgtctgcacagctttcccagggcgcgcagagcaccttcaacgacctgggcgaactgctgacctacgctgcgaactcggtgctgctcccgcccgagcgtttgaccgtatcgcaggcagcgtcgaagtaccgctacctcgacaacgaaggatcgtacgtcggcccctggctcaatgaagagacgccgtaccttgtcgagccgatggacgtgctcaacagccgcgattttgagtcgtgcatcttcatcggccctgcgcagggcggcaagaccgaaatcatcttgaactggatcgcgtacacggcgcgctgcgacccggccgacttcttcttgatccagaccgcgcgcgacacggcgcgagatttctcgtaccgccgtatcgacaagatgcaccgcgacagccgcgagattggcgcactgctgcgtcccggcaatgacaacgacaacatcttcgacaagttctaccgcaacggcatgatgctcacgctgggctggccgacgatcaaccagctctcgggcaagccggtgccgcgtgttgcgctcaccgactacgaccgcatgccgcaggacatcgagaagaacggcccgccgttcccgctggcccgtaagcgcaccacgacgttcggctcgttcggcatgacgctggccgagtcgtcgccgtcgttcgacgtgaaagacccgaagtggaagccgccgcgcccggactcgcacatgttcccgccgactgacggcattggcggcctgtacaacgaaggcgaccgccgctgcttctactggcagtgcccgcactgcggcgagtggttcgagccgaagttctcgctgctgcgctgggacacgaagaaccccgatccgtttgcggcttccgagtcgaccgtcatggcgtgcccgaagaacggctgcgtgatcgagccgaagcacaagtacgagatgaaccgacgcggcgtgtggcttcgcgatgggcagagtctcgaccgcgacggcaacaagcagggcgtcggcgcgcgttcgcgcactgcgtcgttctggctgaagggaccggccgcgcgcttcatcacgtggcagaagctcgtcgagcgtatgttgcaggcccagcagacgttcgagctgaccgctgaaacgaaggcgctgaaggccacgatcaacaccgaccagggcgaaccgttctggccgttcaacgctaccgactcgaaccgcctgccggaagacctgcaatcgaacgcgatcaagtgggccgagaagaaggtgccgtacggcgctcgcttcctgctcgccaccgtcgacgttcagaagaacatgttcgtcgtgaccgtacacggcatcggcccgagcgagagcggcgcgggctacgacgtgtacatggtggaccgcttcaacatccagaagtcgaagcgcaaggacgacgcaggcgatacgttgtgggtcaagccgtacgcggtgcaggaagattgggacttgattacagagcaggtcgtcgagaaggagtacgagctggaagacggcagcggcttcatgtcgatcaagatgacaggcatcgactccggcggtaagtcaggctccacgacgcgcgcctacaactactggcggtcaatgcgtgatagcgccaagggcaaccgagtgctgctcatcaagggcgagccgaagttcggtgccccgcgcgccgagattgactaccccgactcggatcgaaaggatcgctcggccggtgcgcgcggcgaggtgccggtgctgttcttgaactcgaacgtgctgaaggacacgttgctcggcatgctcgacgcgaagaaggacggcggtgctcgctacttcttcaacaagtggacgccggactatgtgtacgtcgagatgacggtggagttccgcgacgacaagaaccgttggttgaacccaggcaagcgacgcaacgaagcatgggatttggcgtactactgcctcggcctctgcaccattctgaaggtcgagcatttcgattgggacaacccggagagctggtacgacgagtggagtaacaactctcttgtgcgacctgccgatcaggaaaagaggtttgcgtcaagcccgactacggattatggtttcggtcaattcggagccaccctgggatgacgcacaatgaccctcgaacagttgcaagccatgcttgcggaggcacaagcggcctatcacaccgccatgatgggcggcgcggtgacggtcgtggtcgaccagaacggggagcgggttgagtacagccgggccaacccggcatccctgctgaagtacatcgccatgctccaggctcagatcaacgccatgctgggggtcgcagtaatcggcggcccccttcgccctctcttttaaggcggcctagaccatgagccaagacctcgcagtagtacgttctccggagggcgatgccgccttccagcgcacgatgaacgacatgattttcggcggtgccttcgagggcgcgaagaacctcaaccgacagaccgcgttgtggtccgcgccctcgctgccgccggacatggaaatcacgccggacaaagtgcgcatggatgcgcgcacccgcgatctgattcgcaacgacggctacatccagggcgcgctcgacacgagcaaggactccatcgtcggcggccagtaccttttgaacgctcggcccgactggcgctcgctcggcttcgacgaaaagtgggccgaagagttccagctcatcgccgagcgcaagttcatgctgtacgccgagtcgccgatgaactggattgacgcctcgcgcaagaacggcctgacgggtctcgtgcgcatggcgctggcccaggcgttcatggcgggcgagacgctggcgacttcggagtacctgaagggcaacggccgtccgtacaagaccgccatcaacatgatcgacccggatcgcctgtcgaatccgaacgacaatagcgacactgcgttcctgcgccgtggcgtggagattgatcgtttcggtgcagcccaggcgtaccacatccgcgacgctcacccgatggaatcctactacgaccgattcggcgcgaagtggacgcgcgttccggcgttcaagccgtggggccgcccgcaggtcatccacatcgccgacatcctgcgccccggtcagacgcgtggtgtttcgcagatggtggcggtgctgaaagaaatgcgcatgacgaaggtctacaaggacatcgttctgcaaaacgcggtggtcaatgcgacctttgctgcggctatcgagtcggagctgccgcgcgagatggtgttcgcgcagctcggctccggcgacatgacgtggttgcagaagtacatgggcgcgctggccgagtacgtgggttcttccgacaacctcgctatcgacggcgtgcgtatcccgcatttgttcccgggcacgaagctcaacctgcaaaacgccggtcagccgggcggcgtcggcagtgacttcgaggactcgctgctgcggcacatctgcgcggcgctgggcctgagctacgagcagttctcgaaggactactcgaagacgaactactcgtcggctcgtgcgtctatgatcgagacgtggaagttcatgcagtcgcgcaagaagctcatcaccgaccgcttcgcgacgatgatctacatgctgtggctggaagaggaaatcaaccgcccggagaccgatctgccgatgccgaagggtgccgcgcatttctacgagggcatcaatcgcgaggcgtacatcaagtgcgactggatcggcgcatcgcgcggccagatcgacgagctgaaggaaacccaggccgccgtgctgcgcatcgcatcgggcctgtcgacgtacgaagacgagctgggcaagctgggcaaggactatcgcgaagtgttcgagcagcacatgcgcgagcagcgcctcatcgagcagaagaagctcaacttcacgatgtcgaccagcaagccgggcacgcagaaggctactgacagcgccgcgaacgatgacgccaaggcggacacggctaccgaaaccgaaacggagaacgacgatgaatgaattgctggcgatgcgcatgtcgatcatggagggcttcaacggccgcccggccctgatcgcaccgcaggagatggagaatatcgcgacgatgttctcgtcgatgatgcttcagcaggccccgccgaccgccgaacagcgcgcggcggctgaagaggcccaggtggtgctcatggagcgtgccttcgacatctcgttcccgcgcgagcgttccaaggcgtttgccttcagcgacggcctcgccttcatcccgatgcgcggcacgctcgtgcatcgtaacggcgactcgtggtacggcacgcgcggctacgacgacattcgtcgcgagttcgacgctgcgatggccgacccggacgtggcgggcatcgtattcgacatccattccggcggcggcatggtctacggcaacttcgagctggccgatcacatccgcagcaagcgcgccgagaagcccaccctgtcggtcgtcaacgcgggcgcgatgtctggcgcgtattcgctgggcagctcggcgaagaagatggtgtcgaccccctccggcgattccggcagcatcggcgtcgtcaccatgcacgtcgatctgagcaaggcgatggagaagttcggcgtcgccatttcgctgatccactccggcgaacacaaggtcgacggaaacccctatagtccgcttcccgacaacgtgcgcgccgacatgcaggtgcgcctggacgggatgtggcagaagttcatttccgtggttgcagctaatcgcggaatgtccgaacaagcgattcgtgacacgcaggcccgcgtctatggcgcggacgatgcggtcaaggtcggcttggtcgatgcggtcatgtctccgcaagaggcagtcgcttccttccgggccgaagtcttcggctcttccaccagcgaaaacaggagtcccaccatgagcgataccaagaagcccgacgccaccgtcgaagagcagaagaagaccgacgccaccgtcgagcagcagaagaagaccgaagagaaggtcgaccacgctgccaacgagcgcgctcgtatcgaaggcatcaccacctgcgaagaagcgaagggccgcgaaggtctcgccaaccacttcgccttcaagagcagcatgagcgtcgacgaagccaaggccgcactcgctgcgtcgccgaaggcgtcggcctccaccggcaagtccgcgctcgacgcggcgatggaaaagaccggcggcggcgctgacatctccaataacggcggcgacggcgaagacgaaggcgacaagggcgagaaggccgatggcggtctgctcggtgcctacgcccacgccaccggcaacaagagcgtgctgaaggccgtcaagtaaagaacaccgtcgccagcctagacgggaaaaaccggctacctagtccactcacaggagtacatcgcaatgaccaactttggccccatcgctggcgtctcggtcgacaacagcaacgccaatggcaacatccagctcttcgctggtgagtccgacatcgttaccacccaggtgcagctcgtgaccggcgtcgcctacgtcggcggtcaggtgctcggccgcgtcaccgcctccggcctgttcgccaagcacgatccggcggcgaccgatggttcgcagaacgcaacccacatcctcggctacgacgttccgacgccgaccgctggcaagtgggaaggtgcgtactcgggcggcgtgttcaacgtcgatgccctgaccttcaacgctgcctccaacaccgtgcagaagaagatcgcggtcttcgacggcacgaacatcgtggcgcagcgcctgtacggcaaccccgccccgaactccggcccggtctaaccggcgattcacccgcaatacgtttcgcacataactcaactgaaacaggagaagcacgatggatttgtatagcactgcggaactgcgcaaggtgatcgtcgacagccggccgcccgtgcagtatttcctcgaccgtctgtacaaggagcagatcaacttcacgaccgaagaaatcatgttcgacgagctgcgtctcggccgtcgcatggctccgttcgtggctccgaacttgcagggtcgcgtcctgaagcgttccggcttctacaccaagaccttccgtccggcctacgtcaagccgaaggatgcggtcaccccgggccgcatgctgcgtcgcttggccggtgaaggtctgaccggcgacatgaccccgggccagcgctggcaggccactgtggccgcgtaccagctcgatcagcgcaaccagatttaccgccgcttcgagtggatgggcgcgcaggccgcgctgtacggtcaggtcaccgtgtcgggcgaagactacccgagcgtgaccatcgacttcggtcgtgccgccaaccacaccgtcatcctgtcgggcaccgccgcgtggagcgactacgacaacagcaacccggacgacgacctggaagattgggccgcgcgtatccgtgaagctgaaggcttcgtggtcactcgcgtcacgatgggcagcaccgcctggaaggcgttccgcaagcacccggccatcaaggagctgctggaaacccgtcgcggctcgaagtcggaagccgagaccggcccgggcctgggcgagagcgtggagtacaagggccagatcggcgcgttcaacatctacgtgtacagcgatgtgtacgaagacgagaccggcaccatgcagccgatgatggacccgcgcgacgtgctgctggaagctgaaggtggcttcgacggcgtgcgtgccttcggcgcgatcatggatgccgacgccggtttgcaggcgctcgacatcttcccgaagatgtggaagaacccggacccgtccgtgatctacctgctgtcgcagtccgcgccgctcatgatcccgagccgtccgaactgcaccctgcgcgcacgcgtcgtcgcgtaaggccgtttcaccagcaacgcccggttcgccgggccgcgctgtttacaccacccaatcaaccccgcaacaggagatgtagaaatggctgacgacaagaagaccaccaaggctgcggccgctggcaagaagctggtcgctcgcgtggcgctgaagggcgacttcgatgccctggatggcctgggcaccgcgatgcaggaaatccaggcgggccaggagttcaccaccgaagacgccaagttgcagaagcagctcgtcgacaacggctacgccaagtcggcgaaggacgcggcgaaggaagaagacgaggctccggccagctctggctccgccccgccgaaggtcgagacgaccgacaagaacgacggcaagaagcagcagtaatcgcgcctgggcgctaggagacggaacatgggctggcttgaaatcaaacaacgcgcgcgtgatgtgacgcacaagacgttcggtatcccagccctgttccgttcggcgggcggcgtgtctacggacacgtccgctcgtttgcactacaaggtgcgcacgtacggcgacctcgaccgcgaaggcttcgcgacgaccgtcgacgatgtggactacgttgtgatcgacactcgcgagctgctggcaaacggcatcgtcgcagaagagggcaaccggattaatttcccgcagctcaacaggactttcaaactcgacgtggagcatccttccgaggacagtcgctacgtcaagtgggcagtaacggagaccgctccatgaccatcggcctgaccatcaacggactcgacgacgtgcgcaagatggtgagcggcataccggaaacggtcgaccgcgcatcggctgttgcgatcaacgaagcgatcacgttcggtcaggccgagagcagccgtcgcattcgcgagcaggttgcgttcaaggcgagctacatcggcaacgcgaccgatccgggcgcgagactgcgtgtagcgaagaaggcccgcgtaggcgacctcgtaggcgtcatctccggtcgtcaccggccgacctctctggctcagttcgagcagggcgcgaagctcggcaaaggcggctacgttcgagtcaaggtttccgcgaccggcggatcgaagcgcatccccggcgcatttccgatcaagctgcggcgcggcaacggcgtgtacgacgccgagaactcgaacgaaggtattgcggtgcggctcaacaagcagggagagctgcccggcggcttgaacaagaagcaggcggtcaacgtgagcggaagcctctacctgttgtatggtccgtccgtcgatcaagtatttcgtgatgttcggttcgatgtgcaaggcccggtgggtgacgcactcgaatcgagcttcctccgcaacttcgggagattgaaccgtggctgatacgaagcgactgttgctggtcaagacgctctgcgattacctgaagagcgaaatcaccctggcgaacggctacaacttcgacctcgcgatggttcgtcgtgacaagcgcaacttcggcaaggagatgaagctgccgggcgtggcggtgctggaaaacttcaaccccgaccgcttgccggaaactatcggcgggttcgtcgggcagaagcacaagtacgatcagatttacctgctcaacggctgggctgacaactcaggactggccgagggcgacgatgagacggatgcggcacatctgctcatgggcgacgtaaaaaaggcgctggggaagttgattaccccgcgcaaccaagacgggttcttcggtggtctcgcaaacacgctgtccatcgaacccggggttgttcggcctcccgacgagcaatccgacaaagcgtacttctggatgagggtccgaatggaactcgtcgagaaggtgggagacccgtactggattcgtgattaacccctgcaacaccacccgaaggagaccacaatgggcagcgagaattacacccttggccgtggcgaactgcgtttcgacaagttcgtaccgggcacccgcaacaagaccggcgagcgttacctgggcaacaccccggaactgaacctcaccaccgagagcgaaaacctcgatcacttcaacagtgaccggggcattcgcacgaaggacaagagcatcgttctggaaaagaccgacagcggcaccttcatcgccgacgaaatcagcgatgacaacgtggccctgtggttcctgggcgacgtgagcgtcgtggcgcaggcggccctcaccgcgcaggtccaggtggttccggccaaccgcgtcaagccgggcacctacatccagatcggcgagtcgctggcgaacccgaccggcgtgcgcaacgtgaccatcaccagcgtcaccgatggcgcgggcacccccgtcccgtacacgctcaacgaggactacaccgtcgactccgagctgggccagctctacgtggtcccgggcggcgctatcgacggcaccgaggcgttcaccatcaactacagcgcggccgcctcgacccgctcgcaggtcgtggtcggcgacggcaccaccgtggaaggcgcgctgcgcttcgtctcctacaacccgaccggcccgcgccgcgactacctgtggccctacgtgcagctccgcgcggacggcgatctggccctgaagggcgacgaatggcagcagctcagcttcgcgttcgacatcctgaagctggacggctacgctaccgtctacatcgacggccgtccccaggtggcgtaaccggggcgcgtcaaacgcggtcaaggccaacttagtcaagaccaagaaggccaagaccaacttcgacaggccgctctccgaaagggggcggcctgttttcttgccagcaaccgaggaagccaatgtccctttcgtcccttcgccttcgcaccatcaccgtcccgtacctgggcgcggatgacgagcagcagagcatcgtgctgttcggcctcaacgccaacgacgtggccggaatcatcatcgcgcagaaagacaacatggaagaaatcttcgacatcgttgaaggtgccggtgtcaagaaagccaccgacctcgctgaagtcgacatgatgcagatcggccagaagctcatggtgcagatgccggacttcatcgcacgcgttatcgcgtacgccgcgcacgagccggaagcgtggatggtcgccatgcagctcgacgcgccgacgcagatcaagtgcatgcgcgccatcgccgaacttaccttcaaggacgaggccggattccgcgagttcctgggaaacgtccaagcggcacttcgcggagcaaaaagcgtggtgccgcacctgcgaaacaaaaatctcgaatcgagcgattcgcagggtggtggctcggaatccgagcagcagtctccttcctgaccgctgaaggacacgctctcgcaggcgagtatccgctgggtgtgttgatcgtagaaacggaactcgcgcgcgagcgtgtcaacaaccgcattagaactgaagcggttttgattcaaagcgcaatcggctccgcgctcagcaagaagggcgcgcaggcattcaaggaacaaatctcggagctataggcgatggccgctcagaacgaagttgaactgatcgtacgtgcgaagaacctcagtacgaaaaccatttctcagctcaatgacgagctgggcaaagtcgccgaaaaccaaaacgaagtagccgatgcgaaccgtctcgccgagcggtcgttcgagagtctgaagggcgagcagcagaagttgctcgctatcatgaagtcgctcaacgaccgctcgcgcaagctggaaggctacgctcagcaagagcagcaggtgcgcagcctccgcgaagaactcgcgcgtgctcgcgaaaacctcaacacgctcgcgcagcagtattacaacaccgagaagccgacgaaggagttcacccagcagttgaaggccgctggcagtgaagtcactcgcctggacgcgtcgctgcggaataacgagcgccgcctggaaacgtcgggcgcgaagctgaaggagatgggcgtcgacacgacccgcttcagccagtcgcagcaggaactcaacagtgcggtcaacaactcgctggcgctgtaccggcagtcgaccgacaacatggagcgctacgacaccgctgtccgcgaagtgcggcagcagcaggaactcgcgcagcaggaagaacggcagcaggcgcaggccgcccgcgattcggccgctgctgttgcccaggccgcgaaggaccgcgaagagcaggcccggaaggagcagcgcttcgtcgagctgaccaccaacgtctaccgcaccctggcccgcgagaaggagaaggcggcggccgccggggcgaacttccgcgccaccggcacgcaggctgcgcaggcggcccgcgctaccgccgcccctgccgtgggtagcgggtcgaccctgggcggggcagcagcgggcgtacaggcggtgctggaaccggccaagcaggcggtcgctacgctcgaccagctcgaaaaggccgtcgaccagctcgacaaggagttcgaggccctgacgccggacgccctgaaggccgctgacggcatcgagaagctggccgaccagagccgccgcctgcgggaagcggccgccgcgctgaagggccaaggcggtctcgccgatgacctcgcgcggcagaacacggccttgaccgccagccagcagcggttcgaggaagcgcgccaggaagtgctgcgctacgccgaagccgtggagcgatcggatcgcccgaacgacgagctggcggcgtcgctgcaacgcgcacaggccgcactgcggcaggcccaggcagacctgggtcgacagaccgaagcgttcaaccgcgtgcagcagcgtgcggcggccgcaggcatcaccctggaaaacctcaacggcatcgagcagcgcctcgctcagaacgccactcgcgttgcgaacggccagaagcaggtcgcgcagacgatgacgcagttggagcagtcgaccgcgaagaccagcaagcagctcaacgcgctcaacaccgggcagcgcaccgcgctgtcgctgtatcagcgtacccgtggtcaggtgctctcgctggtgtctgcctacgtgggcgtgttcggcgcgatcaatctggtgaaccaaagcgtcgacgccgccgtggatcgcgagcgcgcaatgtcgcgtctcatgatcgcaaacaagggcgacgccaacgcggcggcgaaggaatacgactatctgcgcaagaaggctgacgagctgggcctcgccttcggcccgttggcggattcgtacagccggttctcggttgctgcgcgcgatgccggtatgtcggcggaagcaacgcgttatatcttcgagtcgttcacggaagcggcgacggtcctgcgcctgagtggcgaagagactgagggcgcgttccgcgccttggagcagattttctcgaagggctacatccaggcagaagagcttcgcggccagctcggcgaccgcatgaccggcgcgttcaatttgttcgcgaaggctatcggcgtgtcgacgcaagagctgaataagatgctcgaaaagggcggcgaggttaaggcggagttcgtgctgctggcggcgcaaactgcgcgcggtatttatggtccgcaggccaaggccgcatcgaacagcttgctcggcgacattaaccgcatgtcgaacgcgtggggcgatctgaagcgtgaaatcatcgacggcggcctcggtactgcgctgcgcagcctgttcgtcgatctgacgaagttcctgaagagcgacgacggtaagaagttcgctgcgaatctgacgaaggtcttcgtcgcggccgctgaagcgggcaaggagctgatcgacgtattcgccgagtacgacggcctgatcgagaccgtagcgaacaccgtcgccttcctcgtgcggaacttcaaggagctgatcgcgatcatgctggcgatccaggcagcgcgcatcgccatcgtcttcactcagctcgctacggaaatcctgaaggcccgtgcagccacggtcgcgctcaacacggcgctcggtgcgggcacggccgcgtctgccggtcgcgcaggcgcttcgctgctggcgctgatcggcggccccatcgcggcgctgctggcaatcgcttcggcgggcgtcatcatcccgatctatttccagatgaagggcgagctgaagtcgaacaacgacaagctcgatgtgcagaagaccgtcacggaactcaaccgtggttttgcggcgtccgagcgaaacctcgcagttctgtcgcgcgacaacaccgagcagttggaaaagcgcgtgcaggcagcgcagcgcttgctcacgatctacgatgagcagaagaagaacctcgccgatcagatcgcgcagaacacgaccatccgcaagaatcaggtcgcgattcgcactgcgcagagcactcgggaaggcgacgccaatctgccgtcgaagcagttcgaggctatccggcaggtcgaggccgagggcaaggcgatggaggcgcagctcgccaacctcgaacgccgtgcggccccgctgcgcgagctggtcgcatcggccagccgtgacctcggcatcgcgaagtcgaaggcggccgcgaccgagaacgatgcgctgtcggccgagttcaagcgcatccaggccgaggcggacgcagcggcaaagcgtgcgggcacggacaccaaggcagcgaaggcggccgaagcggcgcgcaagaagaaggaggccgaagagaagcgcctcgccgccctggccgagcgccgtgtgcgcctggaagaagacgtggccgagaagctgcgcgacatcgacagcgacatcgcccaggcgcgcccggatacgctggaagaccggctgaaggtgatcgacaacaagatcgctgatcgcaaggcagagttggagcgcatgatccgcgaggcggaaaagctaaacgtgcccgatgcgaagaaggaagcgcagcgcggcctggacgcactgccggacctcgaaaagcagcagaagcagttggccgagcaggagttctacgaggctcgcatcaacaccctgttgcagcagcgcagcacgtccatcgacacgatcaacaccttgcaggaagccggtctgctgacggcaagcgaagcgtccgcgcagatggaagaggtcaacgctcgtctgctgccgcagctcgaagctctgcgactgaaggcggtcgagttcatggctacgctgggcgatggcccacaggcccaggctgctcgcgcgaacctcgaaaacctcaatgcgcagatcaaggcgatgtcggtcgagatgtcggcgactaagcggaagatcgtcgacgtgttcaccaacggcttcacgaacgccttcatggagagcgcggcggtgatgtccgactacctgaagggcatccagagtgcgggcgacgcatggaagagcttcggcgacatcgtgctcaacaccatcgccgacattctcgtgcagctcgcgcagatgattatccagcaggccatcttcaacgcgctgaagcaggcttcggagagcgcgagcggcggctggggcgcgatcatcaacgcggcgatgagctacgtgaagcatgacggcggtgtggtcggcgcggcgtcgaagaagcgtgcggtgccgagctacgtctacgagagcgcggtgcgctaccacacgggcggcgtggcgggcttcgcggccgacgaagtaccggcggtgctgaagaagaacgaagaggtcttgaccgaaaacgatccgcgccaccgcttcaacggcggcatggctggcggcagcggcccggccccggtagacctgtctatcatcaacaccatcgacagcgagagcgtggttgcggccggtgctaacacccgcgctggtcgtcaggcgatcttcaacgtcatcaaggctgaccgagcctccttcaagaaactcctgggcaattaaaggaaccaacatgggacacgcaatcggaactgttacgggcggcagcggcgacgaggcgtactacaaggtactcgctgcgatcaagaccctggctgaagcgaacggatggacgacgctgcgctacgtcaacacaggcacgaaccgcgagctgattttgaactcgaagggcttgtcgggaacggaggacatctacatcggcttccgtacctacttcagcacgagcggcgactactacaatatcctcgtgggcgtgttcaccggcttcgtatcggctaacacgttcgacgctcagccgggcgcgcggctttctggcgtgccgtgccataacaacgccgtcacctacttcatcactgccaacgcccagcgcatcgccggttgcttcaaagtcggcacgccggtctacacgcacttctatgcaggcaagatgttcccgtattcccgccccggcgagttcccctcgccgctggtgtgcgcgggcatgttcgacggcgcagcggcgaagcgattctcggacctcgactacgcgttcccgtatcacggtcgtgagagcggcgcgtcttccccggagcgtccttcgctgctgtggctgcgcgatcaggtaggcacgtggcgtcgcctctcgcatttcccgttctataacggcgcggctggctcgaactcgtggaacggctacaacgcgttggcgaactacagctacttggacacggacgtaagccaccgctccctggtcccggcaggaacgaactaccagccgcagccgatcatcctgtacaccaccacggccagcggcgacacctacgcgggaaatgtcttcggcgagctggacggcgtgtaccagatttccggcttcaacaacaacgtggagaacgtggtgcaggtcggcggcactgcggtggacagcaccggcatgaccgtggctgagcacgtcgatgcagtccttgcggcgggcggccgcgcattcgtgatgctgcaagacgtgggtcgaaccgactggcgcagcttcatcggcttggagatgacctaatgttctacaccggcaatttttcttcgttcgtgacgctgaaggcgtcgatggaagcggcgcttcagaaccacggctgggcgctcaacggcgacggcacgctggaaaagaacggcatgtacgtccgcctcgtggcgaccgacatctaccagatcgcagcgttcgcaggcaccggcagcgccgtcgacccgttccctctgccgggcgcggctccgtacggcgtgaaaatcatgaacttcagcggctcgccgatgaacttcccggcgacctatgacctgcacgtgttcgaggaaaccgatgaggtctacctcgtcatcaattacaacggcgacaagtaccagcagttgtcgttcggcaagtctcgcgtcgatcaggtcggcggcaccggcatgtggctcaccggttcgttccgcagtgacgtggtgcaggcggcaacccatctcgtgtacaccaacgcgtcggatagctacgtcggcttcgggtggagcggcatggggtgtggcttgttccacgaggtatacaacgcgcccctgggctgctcctacatccacactggcctggactcaaccgggtggaagcgcgtagggaccagcgaaggtgatttgatgggcagcggcgatccagttgccgctctgctgcaatcgctgccgtcgcagttcaaccagagcaccgtgctcctgccgttgctcgcggtgcagcgtcgtctctcgaaggggcagactatcgccgcagacctgcaaaacgcgcgcctgtgtcgcaacgacaaccacctgtccggcgaaatcgtgacctacggcaccgaccgctggaaggtgtacccgttccaccgtaagaacgcagcagtgcgcaacggcgtgccgtggtcgaccggcgcggatcacagcggcacgtttgcctacgccattcgctacacggggccgtgacatggcagcacgtatcggacaaatggggagcgcgtttgagcggggcatcgacaacccgatgctcagtgatgacctcaacaaactgactgaagtcgtgtcgatgttcgacagctacgacggcggtcgcttcttgcagggccgctacggtagctggcacgtgcattcgagcaaccaccggggtgtgtcggcgcagcgcaagatgacgagcttcttcgacgactactacaaccgcatcttcatcgtcccggccgccctggatgcgggcaatctgctgtccacgcaggtccggcacatcatcctttggaatgcctacgtcacgccgcagacgttggagtcggccgtgctcggcccgcaggcaggcatttcgatgtctcccccggcgggcgtcagcattccgttcgagatgccgccgctgcgtgagctggatttcaccgttcagatcgaactggcaggcccgccgacgatcagcagctatgcgcgcttcaccgtggaaggcgtcaactacaccgtgccgatcaccggccgccgcatcgttctcttcccgttctctccgaattgggggtctccggtcgacgagacgatcacgcatcgctcgtgggtgctgtcgtcggacgacggtagcgagcagaccggtagcgagtcgggtgaagtgccgcgacgcacgttggagttcaacatcaatctgcggacttctaagcaggcccagcgcgccgagaatctgctgttcgcatggcaggcccgcttcttcggcgtcccgcattggggcgaagagtcgcgtaccgacgcagccgtcgaagcgggctcgctcgttatccccttcaacaccttcggcctgtcgctcgaacccggttcgctggtggcgctgtatctcgacgacgaggtgaacgaaatccgcgaagtgcagcaggtcactgctgacggcgtttcggtcacgaccgggttggagtacgactggcctgccgactcgcgcgtgtatccgtgtttcgttggcctcatgagcgaagagatgtccgagcagcgcgagacttcccgcgttggccgcatggcgatgtcgttcgacttcgagccgagcgtaacgccgggcaacgcggcgatgaacccggacccgatgacctaccgagggcacgagctgtacatcaaggagaccaactggctgtcggcgatgcctttctccttcagcgcggacacgaagcgcgtagacaccggcacaggcaagttcgttgccttcaccacctcgggcttctcgaaaatcagccgccgccataactggacgctgttcgaccgcgctgacattttcgagttccgtcgtttcctcggccgtcgccagggtgttgctcgttcggtctacatgccgagcggcaccgaagatttcacgatggcggcgacgatcctcgacaccgagaactcgctcgtggtggagtcgaacgaatacgcgaagctggtcggtgcgcatcctgctcgccgcgacatcttcatcctgttgaagaatggtcggtatttctgtcgtcgcattacgctggttagcgagttcgacaacctgacccggttgcagctcgacagtgcgctcggcgaagaggtgcggccgcaggatattcgtcggatcagttttttgacgctgtaccgcttccagtctccttccaccacggtgcgctacctgaccgattccaaggccaccgtcgagtcgatgctggtcgccaagatgaccgaggactgatatgtctctggcccaatacgaaagcagcaaagaacaaggctctcgcgtggagctttacctgtttgagagcgacgacggccgttaccgctgggcgtacaccaccgatgcgcgggagcgctcgattggcccgattacttacaggcccgaagcgattaaacgcggcgagctgaagcagaccgcaggcgatgccaacgtcgagagcctggaagtcgtcgtgccgttcgacaaccccgtggcggccgcgcacgtgccgtatctgccgcctcgccctatcaagctgacgatctacgcgtaccagcgcaatgaccccggcgcggaaatcgtgcaggcgttcaccggcttcgtgacgagcttcagccagaagggagctgacgcgacgctgcaatgctcgcagatcatcgacaacctttcgcagacggtgccgtgggtggtgttcaaggtcggttgcgtgtgggcgctgtaccagatcggttgcggcgtcgacaagtcgctgtggcggcgtgatgcgctcatcaccaccgtggacggctacacgctcggctcgcctgagttcgcgtccaagccgaccggctactacaccaacggcttcatcgtcgaccgcgagaccggcgagcagcgtttcatcacggcgcatgacgcagccaccgccacgatcaaggtcgtgtatccgttccaaacggtgcagggcgggcagattctcgacgtgtacgcaggctgcgcacgcacgaaggaagtctgctcgggcaagttcaataacaagatcaactacgtcgggttcgatcacttcccgacctacaacgtcttccagcaggggatcacctaatggcctggatcgcaattatcgtcgcaatcgtcgtcgcaatcgtcggcgagctgctgcggccgaagcagaagttcaacgacccgaacccatcggccgtgggcgacttcaagttccccaccgtggacgcctcgcgcgtcgtaccggtgtggtggggcacctgcaagatgatggggccgaatgtggtgtggttcggcgacctcgaagtcgtgacgctgaagaagaaggtcaagaccggctggttctcgtcgaagaagatcgtcaccgggtacaactactacctgggcgtgcagctcgtgttcggctacggcccggcagacgagttcatcgaactgcgcgtagacgacaaggtggctgaccttgtgcgctcggtgttcaagtacaaggacacgtggctggccggtcaggtcgcgagcaaggagttcgtcggcgacaagtgcgagttctacatctgctcgccgtccattctcgacaacggcgacccgccgagcggcgtagttggcaagtgcgttctgtaccaaggcacgttcacgcagggcacgaacaactacctctccggccagtggaacgaaccggacatgtccgcgttccgcccgttggtgcatatggtcatggagaagtgctacctcggcaacagcgacacgccgccgcccatctcgatcattgctcgccgctgcccgaaccagctcggcctgaccggcggccgccacaacgtcaacggcgacgcgaatatcgcgtgcgcgtcgtatgagttgatgaccaacaacatgtggggcatgaaaatccctgaagacaagatcgacgttgactcgttccgcgcttgcggcaacctgctggctgaagagtcgctgggcatttcgatgctggtgcagtcggccatgctcggcaaagacctcctggccgaagtgctgcgccacgctgacgccgtggtgtacgccgatccggtcaccggcctgtacacgatgacgctggcccgtgagttctcgcaggccgagaaggacgacctgctggttattgacgacagcaatatcctcgaagacagcttcgacttctcgcgcacgtcctgggagatgacgaagaatacgatcatcgttgagtacaccgaccgcgcctcgttcgagaccaagccggtgcagtaccaagacctcgccaacatcgacgtgcgcggcggcatgatcgacgcggagaccttcagctacctcggcttcagcaatgacactgcggcgatgaacaccgctgctcgcgtgtcgaaaatgaaagcgtcgccgctggtctcggcgaagatgtcgctcaaccgcatcggctacaagctgcgtcccggctccggcttctggctgcgcaagccggatcgcggactggcgaacgtgctcatgcgcgtgatcgaaatcagctacggcaccctggacgacccggcgatcaagatcaccgcgatggaggacatcttcgaggtcaacgctgtagcgtacgtgccgccgggtccgggtgattgggttccgccggttactgctctcgcaccgttcgctgcgcagcgcgtgatcgaagccccggcattcggcgctgacgatatgagccgacgctttctcatcacgatgggcgtgcccgcgagcaacggcgtcatcggctacgacgtgtggagcgaccccagcggcgcgtcgaattaccagatcaccaacgtggtcgagggctacacgccgtctgctgttctcttggccggtctgtcgcgcactggcccggaagtcgacaccgcaggcttcaccgtgtcgtcggccatcgggctgaccggtcttgacccaggcaccgatggttcgcgagaggcaggcgagaacctgctgctggtcggcaacgaactcatggcatggaagaacatcgtcgacaacggcaacggcacgttcacgatcaccggggtgtaccgcgctgtgctcgacaccatcccgcaggatcacgctaccggcgcacgcgtgttcttcctgtccgaaggtgcgggcacgaccaacgtcgacggctactcgggcaacgtcacggtcaacacgaagctagctccgaagaacgtgtcgtcgtcgctcgacatcaacctcgcagcagccgtcacggtcacgaccaactcgcgctctctgcggccgctgccgccgggccgaatccgggtcaacgccgcgccggtcggtgctggatcggccttcaccggggacatgatcttgacctgggcgcaccgcaaccgcctggacgggactatcgcctcccaggccgatccgtcacgtacgccggaggaagggacgacctacaacatccgggtctacaccggctcgaacgccctactggcagaagcgcttgcggtctccgacgctgctaccgccgcgaccatccgcctcgcagtagcaggagacatgcgcatcgaaatcgagtcgatgcgggagggcctggcctcgtggtcgaagcaggtggcctacttcagctacactccggccagcggcacgatcacgaacaccatcgcggtcgacgagccggagtacgttcttgacggaggcggcgcgtaatggcccaggtagttgttgcccaacgcatgtggcagcgccgcgacgtagcggcgaactggcaatcgaagaacccggtcctcgcggccggggaaatcggcgtgcagctcggtgcgacttcggacgagaccaagttcaagatcggcgacggcgtgacgccctggaacagcatcggtttcttcgaggggcggctgatcgaaatcggtacgggcggcggctacatccgctggcgctacgtcggtgacgagaactggatcaacctcgtgtcgctcgaatccctgcgcggcccgcaaggcaacgcaggcgcaaccggcgcgaacggcctgagcgcgtatcaggtggcggtggcgaacggattcgccggtacgcaagctgagtggctggcgtcgttgaaaggcgcgaagggtgaccccggtatccaggggccgcccggcatcccatcgcagcgtcgcatccagagaatcactgacaccaccagcggctcggtcatctgcgactggaactcgtacgacgaaatccgagtgacgctcacggccaacacgcagatcaacatggaaggtgctctggacggccagggttgcgttctgttgctgaagcaagacgctgttggcggccgtgcggttaccttcagcaacaatgttcgattcaacaacctcatctcgacctacaacgccacttccacgccgggaaagtctgaccgcatcggtttcgtgtacgacgatgacgacggcttctacgatgtgcaggccgtggtggatggaatctgacgatggccgacgaatacaccccgccgctatcgcccaacatcgtttgggtgttcaagggcaacgagtacaacccgccgctgtcgcccaacatcgagtggattttcggtgctgacgatgacggaggtggcaacgagttgcgcaagtcttcctacatgcttctcttgactatgtgaggttctgaaatgactgttcgagtttattcctcttctgacgcagacgctccggtccttcgcggcaatacgcccggcgacctcatcaacgtgctcgaaaagtgcctcgtcaccggctacggcagcaaggcgggcgcgggctggacgaagccgttcgctggcaccaacgtggccgcattcaagcaaggccctggctccaatggcatgtacctgcgcgtggacgacaccagcaccgccaccagctaccgtaaggcgaaggtcgtcggctacgaggtcatgaccgatgtcaacaccggctcgccgtcgcccttcccgactctcgcgcagaacccgcagggcggcaattggttcacccactacagtagcggctcggtggcgaacccccgcccgtggacgattatcgcagacgagatgttcttctggttgttgctgaccacttacccggagagcggcacgcagtattaccgcgagtgctacgcgttcggcgacatcatcccgttcaagccgggcgacaccacgcacaccatcctgttgcagaacgactcgcccgacagccccaactcttcggagcagtatccgttccagggttacagcatttcttcggcgatgaaccgctaccgcctttcggttgcgcgtgacttcaccaacctgggcggcccgatcacgctcggctggcacaacgatatgaccaagggcaacagcagttggggcaacggtaacctcagctatcctcacggccctgacggcgggctgtacctctctccggtgtgggcgcacaacccgaatgtcggaccctacagtattcgcgggatcatgcccggcatttgggttcactgccactacttcggaatcctgcccgatggcgcgttggtcgaaggccagggcgaactggcagggaaacagttcctccatcgggtgcactaccagaactccgcgttgtttgaaatctccgacacctgggatcggtaaactgaaatgctgctcgccaacctacccctaagctcgccggaaggatcgacttcgtacgcagacgctacaggtcgattttggagcggctacagcgtcgctccgatcatcatcgacggagcggcgcgttttataggcgacggtctgatctacacgaacagcggcggcgatttcctgctcggcacgaaagatttcgacatcgctttcgacatccagactacgagcagtacgctctccaccgttctagactacctgaccggcagcggaagcacgtggcaggtgtatttcagcaccgaggggcgtttgatctggacggcggaaggccccaacgaatcgccggtaatcggtacgacgagcgcggttaacgatggcaactggcacaccgtgctgttccgtcgaagggacggtgtgctgagcgttttggtggacggcgcagtggaagcgtcggtgcctcacgcccgcaactacaactacgcggtcagcacgtttgcaatcggcggtcgtttgtacttgggcttctcgtatattttcaggggcggcattcgcaacgtctacatcaacgtcatcgacccgccgcctgcacccgcacgcctcgccgcgttcattcgccgcagccgcatcggctgggacaaagtaaccaaggttgattcggtcaagaagatcgaggtctatcgcgcgcctccggccagtttgcggaaggtgcagaccaccaagtcgacgcgaggtgtcccgccatggtggggcgctccggggtcgaccaacgtgctgccgacgtacaagctgcgcggccgcgtgatgcagcgagacccggatacgcaagaagacacgccgttgcagaacgtgcgcgtcgctttgttctaccgccgcctgcatacgctgatcgacatccagctctcggatgcgaacggctacgtgcagttcaacaacctcatgcccggcgtccaggcgtactacggaatcgccttcgactcggacggcggcatcatgcagaactcggtactgtgggatcgcctcacgtccgaacccggcccttaattaatcaggagaagcaccatgaccgactcgaagaagctcaccgacgctgacatcgcacgcgcagccaaggcccttgttgtatcccaggcgaaggtgcgcgccattctcgatgtcgaagcgccacgcggcgggtttcaggacgacgggcaggtcacgatcctgttcgagccgcacaagttctcggagtacacgggcggccgcttcgacaagagccacccgcacctgagcaatccggtgtggggcgcggttccctacagcagctacgccagccagcacggcaaactgcaacaggccgtggcgctcgaccgcgacgccgcactgcgcgcaacgagctggggcatcccgcaaatcctgggcaacaactggaagaaagtcggagcggcatcgttgcaggatttcatcaaccgcatgttccgcagcgagggcgcgcagctcgacctcatggtggcgttcatccagagtgacaccgagttgtggaatgctttgaagcgcggcgattgggccaccgtcgcgagaaagtacaacggctcgcagtaccgcaagaaccaatacgacgtgaaacttgcagcagcccatagaaaattcggaggaaactgagatggaaatcaaaccgcgaatcggtgccgacttgtggcacgccatcacccaaggcacgacgctgaaggtgcgtttcattctcgccctgcaaagcctcatcttcggcgcgagtttgctggtccggcccatgcccgccccgacccggtgggcgctgttcgccacgctgccggtctacgcatggtcggcaatgctatggctcagcgggtcgctcatgctgtggcgcgtgctctccacgcggccggtgacgtggctggcttgggcctccaacgtgttcgcgctgttcacttggtttatcatctgcctgtcctatgccgccttcgagggctggcggggcttggttggcacgcacatcctggccctggtcatggctgttttctgcgtgctccgtactgaggcgactcgtagcgatctggaaacagcgtgatggacgttgagctggaagctgcggtcgacaacatgacaggggaattgacggtggatgaaacgaacgcctggaagtgggtggcggcactgctaggaacgctggtgaccggcggcgtcggttgggtcatcaagaggcagcgctcgggccagattctcgacgacaccgagaacgcggccaagactgatttgatcgagcggttgcagaagcggaaccgggagctggaagaacaactcggtgagcttttcaacaaaaccgccgccgggtacaacgaaatcggcgaagccaagcgcgcggccaacatggcgagcatcgaagctgacactgcaaaagccgctgccgcacgcgcatcggaagcagcgtcccacgcgcaaaggatggcgcaggcggccgacgacgtttcagcgaaacgactggtctacatccacgagctgcgtgcgttgctcgtcgccaacaacatcccgttgcccgcgtggccggagggggttctatgagctggttgttgaacacgaggctgggccaggggttgatcctggccgtggtgattctgctctgctggtggggcttcgcctcgcactacgaacagaaggggcgtgacgcatgcaaggccgagggcaacacgcagtacatcaagaccgaggcgaagggccgcgacgtggcccagcaggcggacaaggaagccgcggcggtcgagcagcaggccggacagacgaaggtcgagaccgtcgagaccatccgaaccgtctaccgcgaccggatcgtcaccaagccggtcagccccggtagctgcgtccacccggtcgacccggcggtgcaggccgagctgctggcccgctggaaggacgcgaacgggggtgtgccatgaccgcccgcgccctggtgctggcggccgccctggtggccctgtgcggctgcacgcaggccgttcgcccggcaccgcctaccgtggactgccgacaggccgcctcgacgcccctggaccccctaccggcggctgacgagtgggtggagtgggtgccgcccacccccgaacggcccaacggcctcgcccggctgtccgcacgggccgccgagtgggttgccagtacgctggtagcggtgaagcgggaacgcgccctggcggccgtgcaggagcgttgcctggacgggtacgagaaggcgggggcgatccgccggtagttgacagccccggcggtcggggatagctttagggccgctggtcgcacttcgcgttgcatcggcacctcggtagggaacgcaggaagagaatcggcgctcagcctgcaactggaaaccccggactaaacacccggggttttcttttgcggtcaaggccaagttggtcttgccccggttggtcttgaccgcaaaagaaaggccccgttgctgagacggggccttccgggggtggcgcgactctcgtcggtggccgggtgtcgactgcgtggttctgctgattccggttttcgctatgcgctggtccggctggaagggcaatatcgcttcgacgactcgaccataaggccgcgtgggtcagcgtgtcaagcgtccgtcgatcacctgttccaacttgccgcccaggtgttgcagcgcctccaccatctcgcgccactcgaacatgtgccgcgtgcggaacgtaccgaacgcatacaccgtgatgccgtcccagcggcggccccggatgtcgttgaggctcgctacccgcttccactcgccgcgcgatgcgcctttgatgtcggcgcactgttcggcctgtctgtcgtctccggcgatgatgtagatcatggcttaccccttgaacttctcgacgtgcttcagcattttctcgcgcgtctccttcagtccatcgtcccacgtcttccaagccgccgcgtcgatgtggctcaggatttcgtcgcgggccatgttgctcagcacggtgggcggcagagcgtccagctcccagctcgattcgccaaatcgcttgcggtaattcacgaaacgcgagtccgtggtttttgccgggttcggcggcggcttcaactcttcgatctggtcgtagttcaacgccatgcgcttcaactcgaactcgccgcccaggccgaacaactggaagcgttcgatcaggtcgcgcgtcatgtcgatgccgctcgggtcgtggtcgccgaagtgcaggatcagcacgtccttgtcggcgttgtgttcgatttcccgccgcgcgaaatcacgcacaaccgatgcgctcgggtagccgcgcgccgcgagcagcggcacatcgtaattccagcacacgttttggaacacgccgaccagtgcttccttctcgactacaaggaaaatgcggcggtcctgcgcggcccacgggtcggtgtggtactgcttggcgctggccgtcaggatgtccttcgggttattccaacgcccgcgcgcctcgaacgaacgcgtgcggtcttcgatggcgtcccaatcaaccagaccggcgatgcggccatcgttgacgaggcgggtgatgtacttataggacttctcgttgttcggaatgatgtcgcgggcaacgagctggtagtaaagctggcgcactgtcagcgtgtagccttcgtcctgatagacctcaatgatgccgttgatgcggtcgatcatttcgaggctcttcttcttgaacgtgatttcctgatacatctcgcgcatggcactcggctccggttgttacagcatgatgctcatggaatcgttgaaggtgatcgtgcgctcgtcatcggcacagcgcgtctcttccttcttgatgttcagcgtttcgctgccccgcacgcacacgaagccgtccttagtgacgttgcagaacccggcgctgtggacttcgacctcgacgttggccggtcgaagctcgatggtgacgtgccgcttcatcgccttggcgatttccgagtgggtcaggtgctcggagaagatgaaggggaacgccttgctcacgtccatgtcggcgaacgtggccttcaggatgacgtacttcatacgccgcctcgcttgcggatcgcggtcgcgctgatcgactcgatttcttcagtgaggcgaatctgctcgaccttgtagccgacatcgcgcccgtagtacacgccgttgacgttcggcatcgggaacacgtggaagcagccccggcggtgctgaagcgcggcttcgatacgcgtggtgaccgctacgccgtccagcgggttgctcgggccgttcggcatgaagcgcacgccgatgccgacgtagccttccttcgcgagcacctgctcgaacagcgccgcgtggcctgcgtgccacggctggtagcgaccgatcatgagaccctgggggatcatgaagcggatcgcctcggcgatgtgacccatctcggtcgtgtccgcccaacgttcggtcacgtagtccgcgttctccggcggcacgaacatctcgttggtgtccgggtagcggctctcggcaagggtgttcatgaagacggtcaagtccgctccgaacaccgcgcgaatctccggcgtcggcgcaacgaagtcagacacaaccagaccttcgtgcgtgtcggcaacagcgcgcatgcggtgcgcctgctccatgcggccttccagcgtgaagtcccaattgttcgccgcctcgcgcacggcatcgccgttgacgtgagcggcgttgaggcgcgcggcgagttcccgcgcgaaggtcgacttgcccgagccgggcaggccgcagatcagaatacgcttagccattgtgctgttccttttcgatgcgaagttcttcgcggatttccatgagcagtttgccgagatggttctcgcccttcccgtcgcacacgccccaatacttgtcgccccaccaattgccttcgacgagggttgcgttgccggtcttcagcagcttcgacttcagcggctcggtgccgaacttctggcggagcagctttctcatgacgttgatcttgttctcttcccatccgtcgcgcagcactacgcgcttaccgcgccgcttcgcgcctgcggcgtccggctcgttacggatgcgtcgacgttcgtccatgtcgtcggtctttgcagcctggaacgcgtgctcgaccgtccggtaggagtggccgtcgaaaacgacagcgcacgaccagaagttcgagaggaagcgatacgggcctgcgaagctgccgatggttttcatggtgcctcctagtggatgatcttggccttgccgaacaggatgcgctgcttctggatgtcagtgcgccggatttgttcttcgagcgagacctgcacgttggtcttcatcatcgcgtgcaggtggcgcggctctacgaccttcccggtgacgaacttgtagatggccgagagcagcgacgggttatgcagctcgaagaaactgccggtaagcacccaggggttgtgacggatgctgctggcgatttcgatgagctgcttctcggcctttcgcagatcgagcggcggcgtgatgcccagggtctccatgctgtgcgccacttcgcgcgcaggccgatggacgatcaggaactttgcgccagggaaccgcacgacgagatggtcgaaaaagaacatcgcggccacgtcggagatgaaagccgggccgggcggcatgccgtcaacaaccaggcccagctcgttgatagacgcgcactgctgcaacgggttgtgcagagacgcgcagccgtggccggtgcccgggcggacgaacgcttccatccacgcgctgcgactgcgcggcaggctcagcatgatcgtcaggtcgtggtactcacccatcggcgttctccttcagccgcgcttcgagcaaatcgcgcatggccgatgcgcccttgcccagcggcacgtagaaatggacggtggtgctgtccatcgcatccatgaagaagtgcttctcgtactcgaaccggtgcgagggggtcggatcgccgacaggcagctcttcctgcttgacttcatgcgagtagagctgcggcggcgaggccgggaacaggaggcgctggccgtccaaggggccgccgatgaaatacgcccgcgcgctcatcgctcgcccccgtccccatgcagcacgccgcgctccttgcggtcggccagcttgtcgcggttgcccttcagcaacgccacgtagccgccgctgccgcagtcgaccaggggtgcggtgcgctcggcgaactcgaacgagacgttgaccatctgctgcaatgcctgccgcatttcttccagcttcgcggcggccttggcctcgtcccactgcatgccgtcgcgcatggccttcttgacgacaccctggacgatgcccgcgtgagtgcagagcgccgattgcagatcgaagccactgatccgggcttcgcggtagtgcgcgtcggcgaggcgcgtggctgcgttgcgcaccatgatggcgaacggcggcaggcccttctgctcttcgcacatgcgggcgatgtaccactgcacgtcgcccagctccttccacgccttcgcgtatcggtcggcgcggtagtcgggcttgaccgcttcttcgtcgaacagttcggccagttcgccgacctcgttgccgatgcccagggcgacgtacaggacgcccgcagtgatcgcaacggtgctgagcgtggtcggatacttcgcggtggtctcggtgaactcggcgtagcctgcggccgctgcgtgggcggcgttgacgaaggccagtcggtcttcccgcttcagagaaagagtgctcatgtgggtctctcaggtcagggtgtggggaaagtcggaggcgtactcaatctcgaacaccttcgcgtcgtcgtgcagcaccagcgtcggctcgccgtgcggcggcgggacaaccgcgaagtcgacaccgcgcgtcagctccgtacgcgagcctacgccgtcgactacctgctcgacgaagatgcgcacgtggtcggggcgctcgcgagcggccagtcgctcacgctgcaagatgcgcttggcgaccttgccgccgaacgccttgcgcagcttctcttcgacgctgcccttgtcgcgggtggcgaagatgccggtgcccggcttgcccggcactccgcgcttgtcggcgcgattgtcggtctcgttgtcgcgctgctgcaactcgaacaagcggcgctcgtctgccgcgagctgcttcttgcgccacgggctgagttccttcccctgcgcttcgagctgcttctccttgtcgtacgtgcggaacacgcgacgcaggctgcggttgatattgatgtcggctttcatgagtgtccttgctgcggatatgaaaaagcgacccggccggtattcgacagggccgctcgttgtactactcggtcaaggccgacttagcgaccggcgacgaacttggtctgcttctgcaccttgccgcgcttggtctcacggaacagcacgatggtcgtgttgtcgtcggccatgatgctcgcgtcttccagggcaccggcttcggtgatgaacggaccctgcatgccgcctgccttctgcgtgccgtcttcctgcgcggtcagcagcaggtaggcgaactgcttcgcgcccttcttgccccggcgcacgccggtcttcttcgcagccttcttgcccggcgggcggccgcgcttcggagcatcggcggcgaccttcttcggcgcagccttcttgacggccttcttggcggcgatcagcttcttggcacgcggcttggcagcggccgtgccggtggccttggtcttcttcggtgcggtcttcttggcgggggctttcttcgccgccttcttggttgcttcggtcactgcttcagcggtggcgctcatcgggtatctccattgcgttgttgtcgacaactcgcgggatgcgagcagggttcccttgcgggattcggttactcgcagcccagcgtggagccagggtgcgaggggctgtcttgcaggtattccttgaagtcgcgccagccgtctttgcaggcaaagccccagcggcggacaatcgagccggtcatgaacagcgtccagcacggctcggtgttgttgccgaacagctcgatcatgtgcatgtgcgtcggcggcagcttgcggaagtcgccagcgtggaactgctgggtgtagtcgaagcggttctcgccttcgcgcaagccgctgttcacggtcacgctgccctcgacgtatgtgcggccgtcctgcggcgagaacaggtcgctcatcgccatcacgtacgcgcccatctgcttgttatcgaacgcagggaaccactcgctcgtgtgctcgatgtagcggccttcgagaatgagcgaggcgctggcccacgggtggtcgtgcagagcgcgctcgtcgtcaccgtggacgaacttgtgcaggtacaggttgagccagcggttgcgcgggatcaggtgccagcgggtcaggtagggtcgacgctcgccgccgttgacgccatccagggtgatgacgcggctcggcttgatgaagcgcgcgtactgcttgaacgcggcgacgaacaggaaccagaggccgagcaggcgcagcgcgttgtagaagcgacgcgagactttcggtgcagtcatgggtgcgatcctcgggatgacggggtagttcattcggcgtccagatcgttttcgttggcttcggtcaggccgccggtcggagccggaaccgcacgagtgacgagctgcggcgcgggggcgaagtcgatctggtagcgctgacggaggaacttcagattttcctcgatacgcttctcgaagatttcggccagctcttcgcgggtcagctcgccctcgtggtggccgccctcgccgacgacgcgcagcttgtcttccggttcgccgtgcgtggtgaggttgcggtagttgtgctgatcgaggatcaacttgtcgagcgcgtcgcggactttcggcaggtcttgcatttcgattttcatgttgtctctcggcgtgagaattatggggtgccgtatcgtggcaccggacgccgggtttgcacttcgtcgcgagggggcgcgcttccgtgctaccgggagactggcctcggcccgtctcgttgcagctcgatcttacccggtggggagtccgaagtaaaatcgctactgcggggccactctatcgccagctccggggcttgtcaacacccctccgcgaatccggcggacggctcagccgggccatctttcgctcccctcggaacagccggtcccgcagcatcttttccgtgacgtgcgggcagttgcgttgaatctggtcgaaggtcatctcttcgccgtcgatccggtagagcctgaccgtccccacgcgcggcagttcacccattgcgtgcgccccgtccgtacgtttcgaggtacacacgatgcagctcttcgtgtgcgatggccttgcggaaccccttctggccgaccagggcgtgcgcgaagtcgtgagcactcggttccgggttgccgatgtgctccgtcatgcgcagcgtctcgttgatgtacgcctgcggctcgccttcgacgtagccctcgtccgcgagcaacccgtggatcgcctcacggtacttccggttgcgatgcttctccgcgaccagggctgcgaacagcgtgaggttcgagagaatccagagcgccgtcgccgcgtccatcactcggcctcttcgtcgtcttcgacttcgcggatcagcgacaggtcgtacatgccgtcgccccacttctcggcggccagcgggccagcctgccgcgcgtcctcggcttcgatgtcaccaacgtggcggccgtctttcacgatgcgatatttgggcattgcagttactccggtttgggtgagatgtgcagggtgtcgagaccctgtttgatgcgcttttccacgtgcttgccgaactcgctcgcatcgccgaacaggatgtcgaggtcagggtcggagcactccgctgcgatgccgcgcattacgtcgagcagcatcggcaggtggtgttgcgagctgtagttctggtggatcatcggccacgcgccttgccgcttccaccacgtcttgcgttcgccctcggtcatgccgacgtagatgtcgatcatcgcgcgggccaggaacggcgaccagaagcaggtatcgaccggcgtgatggagtcgccgaactcatcgagcgcgaagtacaccgcgaagatcggcacgccctcaacggtgtagaccggctcatcgagcatgtccttgtacgtcgcgatggtgtagccccggtaaggagccatgtgttcgtagcggcgcttctcgggcggcgggaggggcattggaaagctctcgttgaagtacgggtctgcggtggcggcggcatgcatgcacgcctgcggcgggtcacgtgcggcggcgcgcatggccgcgtagttgcggtcactcatgcgccgcctgcgtctcggatcagcacgacaggctcaccatcggcgtccccgtcaggcaggcatgcggcgagcacgtcggccgcgccctgggcgtcgccgagcacgagcaactggatggcggcgcggatcgcggtttcggtctcgactgctttgcgttcggccgccagcacgtaccccgcaccgtcgcacagctcttcgagcagatgccgcaaccactgtgccgccgtgaggtctttgcggtccaggctcacgccatacttcttcagccctgcctcggcgcgctggcggatgatcgcgatgaggtcgtccgtggtttgcatgtcgctcatggtgtttctcctagtagcggcgcgtcggcgtcttttcgacaacgcggatgtcgtgggcggggaaagaatgctcgccgtcgttctggtcggtgacgtggacccaaccctggtcgaacgtgcagctcttggcgttgcggaagatcagcggcggcgctccgttaaacgtgatgtcgactcgcatcacagaaccctcgtcgtgatgtgcttgcacgcgccttccgtcaggcggtagtcccacatgctcttgtgcttctcgcccgtggccgcgtcgacgatccacgacacgtcggaaacgccgaaacacttcacgcgtgcgatgccgatccgccagtcgtcgccctgcttggcctgataggtgcaagcctggaacagcatcgcgttgctttcgtcggcctcttccttctcctgcttttcgatttccagcatctcgggcgtgatgagcttcagaccagccgccctcacgtcgatattccgaccgtcagacatgcggatgctcacccacgtgccctccatgttgttccacacttcgttgatggtggcgcgctcgcccttcttgatgccgtcgatcttgcgtgccagtgccgtcttccagtcgccgggcgacatgtcgcggacggcttcgacggtgtagcccgaaatgacgctgataggggcacccgccacgttctcaaagctgacccgacctgcgagtccagcgtagtggtcgttcatgtcaaaactccttgtggaaatctttctcggcccggatgagagccgaaaccttggggccgaactttttcggcgtgtcgagcaggatgtcggcggcaccgattgcgacctggggcgagatgaaatagccctggatcggatgcagcacttcgccgaactcgtcgacgatgtagtaggcgacatgcacgcccactccgtcgagcacgatcagcgggccgccgtcgctgcgcacctgctcgctgtgcagctcggcaatgaacacgtcgcggtatggctggatgcgcttgtacttcatgcggccttttccttcaggtggtcgagctgccagcccgcttcgattgcagcgaagagccgcagctcgctcgcgtcctcgtggtcgagcttcagcagcgtcacgaaagcatcgatcatctgcggcgtcattgggcgcttgtcgtagaacctgcggtacgcgctgttcgggtgcatgtcccacacgtcacacaagtcgacgattcgcttgccctcttcccgcaggtgccgacgcatgatgtcgcgcgtggtcttcgggttcttctttaccgtgatcttacggccggtggatggacggaaactcacagcccgatgtcctccgcttcttccttctcgtgttgcttcagccaatgcgtctccggcaggaacgggaacgggccgagccaaccgataacgttgccgtactgcttggcgaacccgtactgatcgtgccaagcgtcgcgacgccacacacagacgcggaactgcttgtagtgcggcgactggcccggccacggttgcaacagcaccgcgtagtagcccatctcgctcgggtcgtcgagcacttccatgtcgttcagcgagagcggcccgtaccacccgtaaatctgagtgtaggtgcgcgacttgtgcagcgtctcgaaccacccgaagcggtcgttgaactcgaagacgtggtacgcgcgtcgcttgctgttgatcgtcgggtagtcgcaaacctgcacgatgtagaaaccggcttcggtcacgtcttccaaggcttcgagttcgagcattacggcagctccacgtttgtgcgcagcgggcggatgcggggcagcgggccgacccaaccgtggacttcaccgcgatgctgctggtcgcttcccaggtagtaccaatggccctcgtaccacacgaggaacgcgtcgacgacgaggttcacgaccttggggtgatctacgcggactgcgtagacccccgtttcagtcggatcgccgatttcttcgtattgcaccttcacgggatgcccgcctttgccgtgtactcgctcaacttgcgcacccagctcacgcgatcctcgatagggatcgacagcagcgaagcatggccgaactccttcagcatctccttcatcacttcgaggcccttatcccggccgaacgtgttcctgaatgcacgcgaggcgtcacgggacatctcaccgatccaaccttccatctgccggatgcgctggtcccgcttctcgacgttggcgaggcgctgctccgcgagggcttcgacttccttcagcgaatccttgaaggcaatcagctcggattcgacctgcacgccgccacggaacagcgtgcggatggcacggatgatgagcgcgcagtcgtcgtacagcacgcccggcggatcgtagtcgcgccaacccggcacacgacggtccagctcgcggccgatgacgcgaatccaacgcaccgcgttctcgccctcattgtgcgtcagcatgtcttcgcggacttcctgcatcaccgcgccgttgtcgttctcgatgtcgatgtagacaaccggcttgacgttgccctcactatcgagcggacgccatttcgcgagccactgtgcatgatcgcggaaagtgtgcttgttgcgaccgtagtggacgccgcccttatgcgtgtccagcgtcaccgtgtgcgtgttgaagtccccctgctgcacgtcgaccaccgtgtagatgtgctcgctgccgacgcgctggtactgctcgccgaccttcggcggcagctcattgccgtggaagggcacgccgtcaagcacctgctgcgtggcgtcgacaacgttcctcggcgcttcggcttcagcgacaaactcagcctcgacaccgctcgcgcgctccgaccgcaggaacgcctgggcgtcgagctggtacgcgtacgggccgacgctgctctgcggcgacagcggagccagggcggtctcgcggtcgacaggggtgaagaggtcagcccacgagcgcgtgctttcccacacacgatcttccggctcgccgtcctgcaagcagtgcatctcgacatgccagtggcgcacgcactgctgcaagccggtcacgcggtagaacttcgtcggctcagtgcggctctgccagtaggagttgatcgagaacgccgggccttcgttgtagttcttcgagtagacacgttggtcgaagctctccatgccgaccttcttggcccacttttcgaggtcgccgatcacgtcgccagtgtcgacgcgcagctcgatgttgacttccttcttgcctgtgcgcgcttcgatgtccagcaggtcgacgcgcagcaggtcgagaatgcccggcgagagcagcatggcttcagcgatggcgtgcgggtcgatgtcgtcgagcacgatatagcgacggtcattgtccttcaggaagtctatgctgccggaaagcatgtggagctgagtgcccgggaacaggtcgcgccccgacgtggctcggaacgccgcttcgctcttgccctgaccgaagctagaagtaaagccgccggagtggaagcccggctgcggcgacggcacgacgccgttgtgcgattggaacatcacgatgtcctggccggtgaacgtgactttggcccactggaacatgcgctcagcctcggccatttgaccgtcatccaggccgatgtggtagccgcgtcggcggtggatagagaagacaatgccctcgtcgttgcaggtagcgatgaggggcagaagcaccggcttcggtgcgttgttggtgaactgcttatcgtacatatcggcggtccttggttgggttaggtggtgcttacgtggcctgcggcttcgcggtcgagttgcaggtcggccatgcccagcaactcttcgtcccaatcgtcaagcgacatccagccgttgacgtgccagtggaggtcgttgagcgtcagcctgggccagaagtagctgtgatccagtttgttctgctcgatgtagcggttgagtgctgcgccccacttctgcgcctcgacctcgcgccacgtcacttcaccctgaccgtggcacagcatgcagatgcggatgtagttgtcgcggagctgcgtggctccctcgcacgccgggcacacctgcttgtcgcggagccagcgggagagcaggcgcatgcgttgccatgcggccagacggattgcagcgagcagtagggtggtggcagcacgcgcgcgagacaaagggggtactcgggcattctgaaaaaccgaaaccctttgggccaacattttgcccttctccaattccatcacggtgtacttgcgcatggccgttactcggtgcgagtgatggtcaggaacgcgaacatggcgtcgttgctggccgtcatgtacgagccgcgttccatcgtgaagcgcttgcttgcgtgctcgggtgcgctgcgcaccttggcgatgccgccggacagcaccgagttcttcgccttgaagaacgattgcgcctgggacgacagcgtggggccgttctctactacgaatcgacgcacgtggcccagcgactcgccgactttgagcttgctgatctggtcgttgagcgagccgggcaggaacaggacgcgcggcttggcgaccttcggcttggcggcggtgctcttccgcttggccgcaagttccttcttgacggtggtcggcatcttgcgcggcttcttgggggcggtcgtgctggtggtgctggcggatgccatcgggcgaatctcctgtgccgtggttggagtaaagggacaggacaaatactactgcgcggccgggggcagttgtcaagcgcccggttctcggtcgtgaccggccgggagctggccgccctgctgcacaaaggtccggctgggtttccgaagcgggagaaaaattgggtccggctgggtctccgaagcgagagcgcgctggctttcgagttcggtttcggcctgccgtggatttttggaacgggctgactttccgaagcgggggctttttctgtaccggaggcatacgtgtacgcggacgcgcgcacgcacctgcacgcacacccgcccgcgctcctgcacaggtcacgcgcctcacctgcgggcgcgtgtcaatgaacgcgcgccgcgcgcggttcgttctcctggccgcgtcgctcatcctgggaagcgctgaacgccgttcagaaaaataattgaaaaaagtatttgcactactgcgcgaggggtgctgtaattcttccaccggcaggcaacaccgccccggcaactaacaaagggaaagcaaccatgaacgcaacgaaccgcaccgccgccattcgcgaagccgccgccctggctgattcgatcatcgaacagcgcacccgccttgccgctggctgggatcagggtatgaagcgcgacgacgaaccgcgctttaccggcgtcaccccgcgcatgcggatggaacgcgacagcgccgccgctttcgcactgtccgcgcagttcgccaccgacgacgtgcgcgaaggcggcgcggttcgcaacgtggttgccaagctggcccacgacatcgctacccctgtcaccgatacggagattcgcgcagccgccgaccgtgctatggcgctggcccgtgacaccctggcgcagcgtcgcccgttcctgggcgtgttcggtgccgccgatgaatccggcatcgccgacgctgcaatggcgaaggtgtgcggttatgcctatctggcgatcatccagaacaacaccgtgagcatcacgacggacgccgacggcatgctcacgaaagcgtgcctcaatcgtgctggcgtgatcctggccgctggcgacgccgttaacgccctggtgcaggcatgagccgccgcagtcgctccgactatgacgcgcacgcgggcctgtccgctgcgcgcagcaccgcaccgcgtccggtgcgcaagcctcgcgcctcgctccccgtgtcgcgcgtcctgggctggctggcgtgggttgtcgtcgccgcagccgcctatcactacgcgccgcgcgtcgcggcccttgtccgggagttcatctaatgcgcgctttccttatctcgctccctggcgtgccggtgttcaccgtccacgccgatgaccgccgcaccgctcgcaattacgccctgggcttgcacggctacaccgtgcgcccgccccgctttatcaccgtcacccccgtctaaggaatcgcacacatgaccatttccctttcccaagcgttcgcacagtggcaggagttagccgccgacattccgaaggatgacggcccggccctggccgaatcgtggaacgactacaccgattcgctttgcaaagacggcgagttgtgcgcgcttcagtatcactacgcgcccgcctatgacgacgacatgcccggcgaaggctcgcgttacgatgaactaagcgatgatcgcgctttcatcctggaacagatgggcgtgaccatgagcgccgagtttgtgccgtttcacgcgtcgcgcaacaaagatgaaaaatcgccgtcgcttaactggcgcgtgacgctgaagaagggcgaccgcgaagtgttgacgacggattacatgcaaggttgcgggcactgcccggcggaacagcgcaacaatttcaacacgccgaccgtcaacccgaaaaccgaaaagcgcgccgccattgcgcaggaatgcgatacggggttcgaggcgaagggcggaatgatgggcggccagttcaagcgcggccgcaagctagagccggaattggtggacgtgttttatagcctcctgtccgactcgcgcgtgttggattgccgcgacttcgccgattgggcgagtgattacggatttgattccgacagcatcaaggcgcgcgctatctatgacgcgtgcatggccgatgcgctgaagatgcgcgccgcgttcggcgataaggcgatgggcgagcttcacgaactgttcgagggcatgtaatcatgagcgacgttatccactcctataccctggaacgcgacggccttacgttccgcgtcgatcactgcgccgacaccgacaacggcgcaccctgggaaaacgaagatggtcacggcaccgtgtccgactggactacgcgcgacaagtcgccgggcgaattggtgttgaacaccgatcacggtagcaaacgcttttatgacttcgccgacgcgtgccgcatcgcgctgcgcgacggctggggcgcgcgtggcgctgaagagggcatgagtaagcgccagattgccgcgctcgccgctcgcgaggattacgaacaccttcgcgcatggtgcaatgacgaatggagctatatcggcgtcgtggtgacgttgctggacatcgaaggcaacgaaacggacgcgacggattcgctgtggggtgtggacgataatggcgactacgcggccaccgttgcgagcgattgcgtggacaacgtgatgcacggcatttcggccatgctgtatggcggcgacggcgcggtgtacatgagcggttcgcgttcgtggagggtgaaggaatgaatatcgacaaccccgcccacggttacctgcgcgacgcgttgcaggccgcttacctggaatacctcaatgcgtttttgacggttgcacgtttcgccgcgcatcacgacattgacgaaaaaaccgcatgggcgattatcgacatgggccgccgtatccacgaggagcgcaccgcatgaacgtcctgtcgcatggcgaacacgtcgcctcaatcaaccgcatgcataaggccgcagacggctacacgccggaaacgccgtggttgctgctgcacaacactggccgcgtcgaccgcttcgcaacgcaacgcgaggcaaaggaagaagcgcgcaagagctacccccgcgttacgttcgaggtgcgctaatgatgactttctcccttgtgttggtgttgatcctgggcggcgagcggcacacgttcgtcatggatagcggcctgaccgcaggcgattgcgtgcaagccctggtagacaaccccggcgcgcctttgcgctgcgaaaaggagtgaccgacatggccgattccctggaacgtctcgccctcgccatgcgtgcgcaggccctcatccaccgcgagcgcggcaggcacaaccgcgcaaaggaattggaggggttcgccttcgccgtggaaacgtgcgccgccctggatagcgccacgttcgcgccaatgccgtttgccgtcatgtgtcacaccctggccgaccgctgcgccgacatcctgcgcaacgatgatgcgcaagtgcgggcgggtcagttcgagcgactgcgcgacgccgaccgcgtggccgtgtctcgcctgcgcgcttatgcgcatggcgtgggcgatgaggcagacgccgcgcccgaactgtttaaggagacgcgcccgtgagcgttcgcattgtcaaaagcccgggccgcgctaacttcccctgggcggtgcagttcaagccgactgaaaattggtcgactgctgcggcctacgccgacaaggggccagcggtggagcacgccgaacggttgcaggcggaatatccgcatctgccggtgcgtgtgcagcactacacgggagggccgcaggcgtgacgccctacacgtattggctgcgcagcactgaccccaaggcgcgcgtattcgtggctgaagggccgcacgaacgcgacacgtcgctagcgctcaccgcgcgccgcctgggcgtcaaggtgtcgacctcgcgcggcgtggccgtgtatggcctggacacgacgccggttgtgcgcgtggtgaaggaggattgacgcatgaccctggaaccactgaccgaaaccgaaaagcgcaaaatcatccgcgcaaacattctggccgatagtctgctgcgccttgtgcagtgggttgcgttcctggcgatcctgggcgcgcttgtcctgccgctggcagtgcaggcgtggcacaaggccggtgcgatcaccgccgccgtggtgcttgccctgggcgtggcctgcgcgtggcacgtcaagccacacggccgcagctacgcggcgcaggtgcgggacatcgaagcccggcacaagccacacgaataaaaccccgcacccccacacccccacgtctgccactgtctagccctcgctcacgcgggggctttttattgcgcgttcgtctgtccctgggcgctcgccctggccgcctacccttgggcgcgcctttccctggtaacgctatggcctgcgcagtgagcacacctgcgcgcccgcatttgcgcatttccgcattgcgcacgtcctgctgactcgctaacggcctgcacctgggcgcacgtcctgctgatttgtggtcgacctgcggcacacccgatagccctgcacctgggcatttcccgcattgcacgcatttaatttattgcatgggcctagaggcgcgtgtgcgcgtgcgtgtgcgcattgcatttatttcccttttattcgcatcaccgcatggccgcgcggcccgcacgcacgcattgcggcggcgcaggagggtaaaagggatagcggcgatgcgagtaaaaaggtacttccggccctggcgcgggcgtcgcggggggcgctgaccccggtgctcgcgcatttttcaattttttcgcatttccgtctcctataaggggccgaaccgcgcgctgcaccgcatttccgggctaggaattaatttattcgcttgtgacagtagtgacactgacgatttgcggtactgtcacaactcggccccccgcgcaaacggttgatttggaagggttttgaggtcgatttgctactgcgagttgggcctttgtgacactgtgacactgaaaccttctcccttaccgggaaagaaaacacgaaaaacggccacaaattagtaccattgctaatatttgagggacaattcgtattcctgcgtgtagcagaaggtactgtcactactgtcactactgtcacaaaataagaggaaaagtaggcaggacaagggtttcggcttgtgacagtaccttgtgacagtgacgcttttttcgccacatcggcccaaattaattcgtcagtgtcacaaggagttaattcccgggcttgtgacagtaccttgcgcgattggaaagaattgccgataattaattcgccggaaattcgtccggcacaccgagaaatgccgatgatcgctgaaaccgacgaaattgagagcacgcgcgctgacttcgaggaagccgtctacaagaaatatttcgtgtcgcagatcagccgcaccctgctgctgaaaaaaggagtggccgacaaggcgaccctgctggaacggaaaaagaaaggcgcgtaccggcggccggaaattgccgcgatgtggttcgggtggaaattgcgcattgaggccaagccggacccggcatggcaggatcgagtcggctaattcggcgcaacgaaaaacccccggggcgacccgggggtttctttttgcctcgctgccggtgtgcgtttattcgacgcgggtgtccggcacgttcgagccgggttcgccagcgcccggcggcagatcgcggcggccttcgtacgcagcggcgtcggtcgtggcttcgtctacggtggcctggggctgctgcacttccgacttggtgctgccgaagaactctccggtctcgtcgatggtgagctgctggcccgagtgcaggctcacttcgatgctgcggcccgggccgagttcgccgacgctgttgccttcgagcttgacggcgagcgccttgttaccgtggacgtacgagagtttgacggtggtggtcattgcgtttctcctgtgccctggattgggcggttgtaggttacatcttgatgcgtgcgagttcgatgaagtcggtgatccaggcttgcaggttcggcttcatcaccagctcgggatgcttcgaccaatagcgcgccagcttgccgctcgcaccgcgcgcccggccaacgtagacgaagcccttggcggtcaggaagttcgacagcttcggcccgaacggaactccgcacgacgcatccagcgccgcgtcgcgcagcctgccgacgttgagcagcatgttgttgacttccgggtcggtgctctcgttgatgatttccagcagctcgtcttcgtcgtcgccgcgagccaggtcgatcatgcgttccttggcgtccgtcatcggcgcgtggccgtccgggtcgaactcgggatgcagcgggtagtcttccagccactcgcgcagcgcgcccgcgtgataggcgatggcgttgaagatgtcgtcgtagtggtcggggtgctgcgcgcggaacttctcgatcatctgcttcgtctggaagtgagtcgagaccacgaagtaccggcggtcggcgtcgtacaccggcagcgcgtcgctgtgattggtcaggatgatcgtggagctgacgttcggcacgttgaagccgccgctgtgcatcttgcggatgtccaccacgtcgttcgtgatgtagggcttcagcttgtccatcacggcgtagcgcgacgtaccggcgatgcgggcttcctcgaacacgacgaccttgttgcgctcgtagaactcggtgtacttctcttccaggcgttgcgcgttgacggtgatgacgttgttcttcgacaggatcgccatgagcatttcgccgacgaaacccttaccggcaccgtcgataccctgcatcaccacggcccagcgaatcttcttgtccatgcgcttgatagtgaacgccagccaggacagcagcagctcgcgctcgcgctggatcgggtaggaaatctcgaagtgacgcttcaccgcctcgaccgcacgccgcgccttgccgcccatcttctcggggatcggcacgatgtcttccgggttgaacaggttgacgtgcttctggtcattccattcaacgattcgctcggcaccgggcaggtacacgtagccgctcacgaccggaacctgatacacgttgagcgccagggccgatgcctgctgctccggcaccgcgtccatgttcgagcgatccttcttcgacagcaggtggcggttgttgcgcgcgttgaacgcacgctcgctcagcgcgacgcggttctccatcaagaagaactcttcctcggtgtcgacgtacaccacgtcgttgcaccagaacggcagctccttgtagttgaagtcggaattgcggtagccctcgttcaccgccttgcgtacggtcgcgatgctcggcgacttgccggtcagctccttgacgcgcttctggatttcgcccaccagcagctcggcctgatagtcgtgctccatcaaccggccccacttcttcgccagcgggccaagaagttccatcgcgctttcggtctcatgtaccttgcgcttgatcttctcgaactgttcctcggcgacctcctgccggtgctccttcgcgatcttgatgagcgatgcggccgtggtgatgttccggcccatctcatcgtggaacgtgttccacttttcttccagcgagtcggcgtcgtattcgctcgacgtttcggaccactcgtgccagagcgacaggccctcttcctcgccgtcgaattgatggtgcagcgccatgccgaccttcaaccactgctcgtagtcgtcagcacccggcacccattgcagcacctcgcggagctgatcggcggtcaggttttcgagcggctgcttgtgcgccagcagtgcgcggtcgttctcgtcgtcgatgtcgtcgcgactcgcatcgcgcggtgcgttgtgcttcttcaacgtccagccgcgacgctgcgcttcgagcttgaagaccgagaacaactcgtcgatggcgtcggtcgtgatttccggcagcatgtcgtgcggcacgctcaccgggttcatgcccttgccggaagtccagcggtacggcttcttcgtctccgggtgcaggccgatgccaacaaactgctggccgtcgcccaggacttcgattgcgtgctcggtaccttcttcgtcgacgaaggtgatcttgcgcttctggaacgggatgtcggtgcggtacacgagcatggtcttcggggccatgccgacacgcgtcatcgtcttgccgcagatttcaagcgcgtgctcggccatcaactcggccatctcggcgtcgtagatgtcgatgtccacggcaggcgtgtgcttcgtcaagaagccgatgttgccctgcgtgtagtcgccgctcgcccacttctttaccagcttcggcgttgcttcaatatgctgccacttcggctcgattgggcctttccgtcccttcggaatcgggatgatggagtagccgttttcgagcaactgcgcgccgtatttgcgaagcacgctggtgatcggtcgtccagccatgtgcgtcactccgcgatgtcgtcgccaacgaggtcttcgagattgaatccaatctcacggttgaagtctttgtgcaagatcgaagccttgtcgcgcggcacgcatccgagacgttgccaacgcgacacggtggtctcgtgccagttgtacttctcgcagattgcgttgagccgaccgtacggcgggtcgagcattagggcgatgcgccggagtagatagcggacgcgcgcgtcggcgctgtccagtgaatcaagggttaggtctcggcgcatggaatcctcgcggcgtgtgggtttcaaggggtctgctaagccgctttgcgtgcctattgacttagcgttgggacgggcgcatagtgcgctcgccgggcaggaattgcaatccgcccgtcactcccaaaaccaacctagctaggagcaacaaaccgatgtccaccatcaacgcgaagaagctcgccgccgccatcgttctcatcatcgaagccgtgggcgggaccagcagcaacagctccgtcaacgaatccgaagacggtggtgacgaagaagaagcgccgaagcgcggtcgcggccgcccggcgggcagcaccaagaaggcaccggccgagaaggccgctccgaagggcaagggcaagtcgaagcccgacccgctggacgacgaagacgaagaagaaggtgacggcgacgaggacgaaggcgacgacgacctcggcctggaagacgacgaagaagaagtgacccaggaagagctggtcgcctccttcaaggcgctgaagtccagccacggcgtcgacgcctgcaagaaggtgctggccctgctcgacgagagcaacgtcctgaacattccggccaagaagtacccggaagcgatgaaggaaatcaagcgcgcggccagccgcaagaagtaattcggcctgcacgtaacacggacgcccggcgatgccgggcgttctttcgagaggacacgatgaagccacgtcgcaacaaactcgcaaaggccgtcaaggaagcagtgcgtgcgcatgcgcgctttgcgccgtcgtctgcacagcgcatcttcgactgcccggccagcttggtgctcaacgagcaggagccggacagcgagaactacgaggcggccgaaggcaccgttgcgcatcacatcggcgagacctgcctgttgaccggcaaagacccggaagagtttctaggaatggtgttcgatagcggcaaccttgatgccgactacgacgaagagcttcattcctcgaaaggcttcgctatcactgttgacgacgagatggttgctggcgtcggtcagtatctcgattacgtgatgcgtctgccggggtgccacttcgttgagcagcgagtgaacatctcgcggtggtgcccgatccccgatcagttcggcacgtgcgaccacgcagcggccatgtacaagaagctggtcgtcaccgacttcaagtacggccgtatcttcgtcgagccggagaacaacttccagctcatcatgtacgcgctcggcttcatcaacgagtgggactggctgtacgacttcgacgaagtggtcatccgcattgcgcagcc

SEQ ID NO: 13 - DNA, 56147 bp, Unknown
  Bacteriophage Xfas103
gtcagcgccccccgcgacgcccgcgccagggccggaagtacctttttactcgcatcgccgctatcccttttaccctcctgcgccgccgcaatgcgtgcgtgcgggccgcgcggccatgcggtgatgcgaataaaagggaaataaatgcaatgcgcacacgcacgcgcacacgcgcctctaggcccatgcaataaattaaatgcgtgcaatgcgggaaatgcccaggtgcagggctatcgggtgtgccgcaggtcgaccacaaatcagcaggacgtgcgcccaggtgcaggccgttagcgagtcagcaggacgtgcgcaatgcggaaatgcgcaaatgcgggcgcgcaggtgtgctcactgcgcaggccatagcgttaccagggaaaggcgcgcccaagggtaggcggccagggcgagcgcccagggacagacgaacgcgcaataaaaagcccccgcgtgagcgagggctagacagtggcagacgtgggggtgtgggggtgcggggttttattcgtgtggcttgtgccgggcttcgatgtcccgcacctgcgccgcgtagctgcggccgtgtggcttgacgtgccacgcgcaggccacgcccagggcaagcaccacggcggcggtgatcgcaccggccttgtgccacgcctgcactgccagcggcaggacaagcgcgcccaggatcgccaggaacgcaacccactgcacaaggcgcagcagactatcggccagaatgtttgcgcggatgattttgcgcttttcggtttcggtcagtggttccagggtcatgcgtcaatcctccttcaccacgcgcacaaccggcgtcgtgtccaggccatacacggccacgccgcgcgaggtcgacaccttgacgcccaggcggcgcgcggtgagcgctagcgacgtgtcgcgttcgtgcggcccttcagccacgaatacgcgcgccttggggtcagtgctgcgcagccaatacgtgtagggcgtcacgcctgcggccctcccgtgtagtgctgcacacgcaccggcagatgcggatattccgcctgcaaccgttcggcgtgctccaccgctggccccttgtcggcgtaggccgcagcagtcgaccaattttcagtcggcttgaactgcaccgcccaggggaagttagcgcggcccgggcttttgacaatgcgaacgctcacgggcgcgtctccttaaacagttcgggcgcggcgtctgcctcatcgcccacgccatgcgcataagcgcgcaggcgagacacggccacgcggtcggcgtcgcgcagtcgctcgaactgacccgcccgcacttgcgcatcatcgttgcgcaggatgtcggcgcagcggtcggccagggtgtgacacatgacggcaaacggcattggcgcgaacgtggcgctatccagggcggcgcacgtttccacggcgaaggcgaacccctccaattcctttgcgcggttgtgcctgccgcgctcgcggtggatgagggcctgcgcacgcatggcgagggcgagacgttccagggaatcggccatgtcggtcactccttttcgcagcgcaaaggcgcgccggggttgtctaccagggcttgcacgcaatcgcctgcggtcaggccgctatccatgacgaacgtgtgccgctcgccgcccaggatcaacaccaacacaagggagaaagtcatcattagcgcacctcgaacgtaacgcgggggtagctcttgcgcgcttcttcctttgcctcgcgttgcgttgcgaagcggtcgacgcggccagtgttgtgcagcagcaaccacggcgtttccggcgtgtagccgtctgcggccttatgcatgcggttgattgaggcgacgtgttcgccatgcgacaggacgttcatgcggtgcgctcctcgtggatacggcggcccatgtcgataatcgcccatgcggttttttcgtcaatgtcgtgatgcgcggcgaaacgtgcaaccgtcaaaaacgcattgaggtattccaggtaagcggcctgcaacgcgtcgcgcaggtaaccgtgggcggggttgtcgatattcattccttcaccctccacgaacgcgaaccgctcatgtacaccgcgccgtcgccgccatacagcatggccgaaatgccgtgcatcacgttgtccacgcaatcgctcgcaacggtggccgcgtagtcgccattatcgtccacaccccacagcgaatccgtcgcgtccgtttcgttgccttcgatgtccagcaacgtcaccacgacgccgatatagctccattcgtcattgcaccatgcgcgaaggtgttcgtaatcctcgcgagcggcgagcgcggcaatctggcgcttactcatgccctcttcagcgccacgcgcgccccagccgtcgcgcagcgcgatgcggcacgcgtcggcgaagtcataaaagcgtttgctaccgtgatcggtgttcaacaccaattcgcccggcgacttgtcgcgcgtagtccagtcggacacggtgccgtgaccatcttcgttttcccagggtgcgccgttgtcggtgtcggcgcagtgatcgacgcggaacgtaaggccgtcgcgttccagggtataggagtggataacgtcgctcatgattacatgccctcgaacagttcgtgaagctcgcccatcgccttatcgccgaacgcggcgcgcatcttcagcgcatcggccatgcacgcgtcatagatagcgcgcgccttgatgctgtcggaatcaaatccgtaatcactcgcccaatcggcgaagtcgcggcaatccaacacgcgcgagtcggacaggaggctataaaacacgtccaccaattccggctctagcttgcggccgcgcttgaactggccgcccatcattccgcccttcgcctcgaaccccgtatcgcattcctgcgcaatggcggcgcgcttttcggttttcgggttgacggtcggcgtgttgaaattgttgcgctgttccgccgggcagtgcccgcaaccttgcatgtaatccgtcgtcaacacttcgcggtcgcccttcttcagcgtcacgcgccagttaagcgacggcgatttttcatctttgttgcgcgacgcgtgaaacggcacaaactcggcgctcatggtcacgcccatctgttccaggatgaaagcgcgatcatcgcttagttcatcgtaacgcgagccttcgccgggcatgtcgtcgtcataggcgggcgcgtagtgatactgaagcgcgcacaactcgccgtctttgcaaagcgaatcggtgtagtcgttccacgattcggccagggccgggccgtcatccttcggaatgtcggcggctaactcctgccactgtgcgaacgcttgggaaagggaaatggtcatgtgtgcgattccttagacgggggtgacggtgataaagcggggcgggcgcacggtgtagccgtgcaagcccagggcgtaattgcgagcggtgcggcggtcatcggcgtggacggtgaacaccggcacgccagggagcgagataaggaaagcgcgcattagatgaactcccggacaagggccgcgacgcgcggcgcgtagtgataggcggctgcggcgacgacaacccacgccagccagcccaggacgcgcgacacggggagcgaggcgcgaggcttgcgcaccggacgcggtgcggtgctgcgcgcagcggacaggcccgcgtgcgcgtcatagtcggagcgactgcggcggctcatgcctgcaccagggcgttaacggcgtcgccagcggccaggatcacgccagcacgattgaggcacgctttcgtgagcatgccgtcggcgtccgtcgtgatgctcacggtgttgttctggatgatcgccagataggcataaccgcacaccttcgccattgcagcgtcggcgatgccggattcatcggcggcaccgaacacgcccaggaacgggcgacgctgcgccagggtgtcacgggccagcgccatagcacggtcggcggctgcgcgaatctccgtatcggtgacaggggtagcgatgtcgtgggccagcttggcaaccacgttgcgaaccgcgccgccttcgcgcacgtcgtcggtggcgaactgcgcggacagtgcgaaagcggcggcgctgtcgcgttccatccgcatgcgcggggtgacgccggtaaagcgcggttcgtcgtcgcgcttcataccctgatcccagccagcggcaaggcgggtgcgctgttcgatgatcgaatcagccagggcggcggcttcgcgaatggcggcggtgcggttcgttgcgttcatggttgctttccctttgttagttgccggggcggtgttgcctgccggtggaagaattacagcacccctcgcgcagtagtgcaaatacttttttcaattatttttctgaacggcgttcagcgcttcccaggatgagcgacgcggccaggagaacgaaccgcgcgcggcgcgcgttcattgacacgcgcccgcaggtgaggcgcgtgacctgtgcaggagcgcgggcgggtgtgcgtgcaggtgcgtgcgcgcgtccgcgtacacgtatgcctccggtacagaaaaagcccccgcttcggaaagtcagcccgttccaaaaatccacggcaggccgaaaccgaactcgaaagccagcgcgctctcgcttcggagacccagccggacccaatttttctcccgcttcggaaacccagccggacctttgtgcagcagggcggccagctcccggccggtcacgaccgagaaccgggcgcttgacaactgcccccggccgcgcagtagtatttgtcctgtccctttactccaaccacggcacaggagattcgcccgatggcatccgccagcaccaccagcacgaccgcccccaagaagccgcgcaagatgccgaccaccgtcaagaaggaacttgcggccaagcggaagagcaccgccgccaagccgaaggtcgccaagccgcgcgtcctgttcctgcccggctcgctcaacgaccagatcagcaagctcaaagtcggcgagtcgctgggccacgtgcgtcgattcgtagtagagaacggccccacgctgtcgtcccaggcgcaatcgttcttcaaggcgaagaactcggtgctgtccggcggcatcgccaaggtgcgcagcgcacccgagcacgcaagcaagcgcttcacgatggaacgcggctcgtacatgacggccagcaacgacgccatgttcgcgttcctgaccatcactcgcaccgagtaacggccatgcgcaagtacaccgtgatggaattggagaagggcaaaatgttggcccaaagggtttcggtttttcagaatgcccgagtaccccctttgtctcgcgcgcgtgctgccaccaccctactgctcgctgcaatccgtctggccgcatggcaacgcatgcgcctgctctcccgctggctccgcgacaagcaggtgtgcccggcgtgcgagggagccacgcagctccgcgacaactacatccgcatctgcatgctgtgccacggtcagggtgaagtgacgtggcgcgaggtcgaggcgcagaagtggggcgcagcactcaaccgctacatcgagcagaacaaactggatcacagctacttctggcccaggctgacgctcaacgacctccactggcacgtcaacggctggatgtcgcttgacgattgggacgaagagttgctgggcatggccgacctgcaactcgaccgcgaagccgcaggccacgtaagcaccacctaacccaaccaaggaccgccgatatgtacgataagcagttcaccaacaacgcaccgaagccggtgcttctgcccctcatcgctacctgcaacgacgagggcattgtcttctctatccaccgccgacgcggctaccacatcggcctggatgacggtcaaatggccgaggctgagcgcatgttccagtgggccaaagtcacgttcaccggccaggacatcgtgatgttccaatcgcacaacggcgtcgtgccgtcgccgcagccgggcttccactccggcggctttacttctagcttcggtcagggcaagagcgaagcggcgttccgagccacgtcggggcgcgacctgttcccgggcactcagctccacatgctttccggcagcatagacttcctgaaggacaatgaccgtcgctatatcgtgctcgacgacatcgacccgcacgccatcgctgaagccatgctgctctcgccgggcattctcgacctgctgcgcgtcgacctgctggacatcgaagcgcgcacaggcaagaaggaagtcaacatcgagctgcgcgtcgacactggcgacgtgatcggcgacctcgaaaagtgggccaagaaggtcggcatggagagcttcgaccaacgtgtctactcgaagaactacaacgaaggcccggcgttctcgatcaactcctactggcagagccgcactgagccgacgaagttctaccgcgtgaccggcttgcagcagtgcgtgcgccactggcatgtcgagatgcactgcttgcaggacggcgagccggaagatcgtgtgtgggaaagcacgcgctcgtgggctgacctcttcacccctgtcgaccgcgagaccgccctggctccgctgtcgccgcagagcagcgtcggcccgtacgcgtaccagctcgacgcccaggcgttcctgcggtcggagcgcgcgagcggtgtcgaggctgagtttgtcgctgaagccgaagcgccgaggaacgttgtcgacgccacgcagcaggtgcttgacggcgtgcccttccacggcaatgagctgccgccgaaggtcggcgagcagtaccagcgcgtcggcagcgagcacatctacacggtggtcgacgtgcagcagggggacttcaacacgcacacggtgacgctggacacgcataagggcggcgtccactacggtcgcaacaagcacactttccgcgatcatgcacagtggctcgcgaaatggcgtccgctcgatagtgagggcaacgtcaagccggttgtctacatcgacatcgagaacgacaacggcgcggtgatgcaggaagtccgcgaagacatgctgacgcacaatgagggcgagaacgcggtgcgttggattcgcgtcatcggccgcgagctggaccgtcgtgtgccgggttggcgcgactacgatccgccgggcgtgctgtacgacgactgcgcgctcatcatccgtgccatccgcacgctgttccgtggcggcgtgcaggtcgaatccgagctgattgccttcaaggattcgctgaaggaagtcgaagccctcgcggagcagcgcctcgccaacgtcgagaagcgggaccagcgcatccggcagatggaaggttggatcggtgagatgtcccgtgacgcctcgcgtgcattcaggaacacgttcggccgggataagggcctcgaagtgatgaaggagatgctgaaggagttcggccatgcttcgctgctgtcgatccctatcgaggatcgcgtgagctgggtgcgcaagttgagcgagtacacggcaaaggcgggcatcccgtgaaggtgcaatacgaagaaatcggcgatccgactgaaacgggggtctacgcagtccgcgtagatcaccccaaggtcgtgaacctcgtcgtcgacgcgttcctcgtgtggtacgagggccattggtactacctgggaagcgaccagcagcatcgcggtgaagtccacggttgggtcggcccgctgccccgcatccgcccgctgcgcacaaacgtggagctgccgtaatgctcgaactcgaagccttggaagacgtgaccgaagccggtttctacatcgtgcaggtttgcgactacccgacgatcaacagcaagcgacgcgcgtaccacgtcttcgagttcaacgaccgcttcgggtggttcgagacgctgcacaagtcgcgcacctacactcagatttacgggtggtacgggccgctctcgctgaacgacatggaagtgctcgacgacccgagcgagatgggctactacgcggtgctgttgcaaccgtggccgggccagtcgccgcactacaagcagttccgcgtctgtgtgtggcgtcgcgacgcttggcacgatcagtacgggttcgccaagcagtacggcaacgttatcggttggctcggcccgttcccgttcctgccggagacgcattggctgaagcaacacgagaaggaagaagcggaggacatcgggctgtgagtttccgtccatccaccggccgtaagatcacggtaaagaagaacccgaagaccacgcgcgacatcatgcgtcggcacctgcgggaagagggcaagcgaatcgtcgacttgtgtgacgtgtgggacatgcacccgaacagcgcgtaccgcaggttctacgacaagcgcccaatgacgccgcagatgatcgatgctttcgtgacgctgctgaagctcgaccacgaggacgcgagcgagctgcggctcttcgctgcaatcgaagcgggctggcagctcgaccacctgaaggaaaaggccgcatgaagtacaagcgcatccagccataccgcgacgtgttcattgccgagctgcacagcgagcaggtgcgcagcgacggcggcccgctgatcgtgctcgacggagtgggcgtgcatgtcgcctactacatcgtcgacgagttcggcgaagtgctgcatccgatccagggctatttcatctcgccccaggtcgcaatcggtgccgccgacatcctgctcgacacgccgaaaaagttcggccccaaggtttcggctctcatccgggccgagaaagatttccacaaggagttttgacatgaacgaccactacgctggactcgcaggtcgggtcagctttgagaacgtggcgggtgcccctatcagcgtcatttcgggctacaccgtcgaagccgtccgcgacatgtcgcccggcgactggaagacggcactggcacgcaagatcgacggcatcaagaagggcgagcgcgccaccatcaacgaagtgtggaacaacatggagggcacgtgggtgagcatccgcatgtctgacggtcggaatatcgacgtgagggcggctggtctgaagctcatcacgcccgagatgctggaaatcgaaaagcaggagaaggaagaggccgacgaaagcaacgcgatgctgttccaggcttgcacctatcaggccaagcagggcgacgactggcggatcggcatcgcacgcgtgaagtgtttcggcgtttccgacgtgtcgtggatcgtcgacgcggccacgggcgagaagcacaagagcatgtgggactaccgcctgacggaaggcgcgtgcaagcacatcacgacgagggttctgtgatgcgagtcgacatcacgtttaacggagcgccgccgctgatcttccgcaacgccaagagctgcacgttcgaccagggttgggtccacgtcaccgaccagaacgacggcgagcattctttccccgcccacgacatccgcgttgtcgaaaagacgccgacgcgccgctactaggagaaacaccatgagcgacatgcaaaccacggacgacctcatcgcgatcatccgccagcgcgccgaggcagggctgaagaagtatggcgtgagcctggaccgcaaagacctcacggcggcacagtggttgcggcatctgctcgaagagctgtgcgacggtgcggggtacgtgctggcggccgaacgcaaagcagtcgagaccgaaaccgcgatccgcgccgccatccagttgctcgtgctcggcgacgcccagggcgcggccgacgtgctcgccgcatgcctgcctgacggggacgccgatggtgagcctgtcgtgctgatccgagacgcaggcggcgcatgagtgaccgcaactacgcggccatgcgcgccgccgcacgtgacccgccgcaggcgtgcatgcatgccgccgccaccgcagacccgtacttcaacgagagctttccaatgcccctcccgccgcccgagaagcgccgctacgaacacatggctccttaccggggctacaccatcgcgacgtacaaggacatgctcgatgagccggtctacaccgttgagggcgtgccgatcttcgcggtgtacttcgcgctcgatgagttcggcgactccatcacgccggtcgatacctgcttctggtcgccgttcctggcccgcgcgatgatcgacatctacgtcggcatgaccgagggcgaacgcaagacgtggtggaagcggcaaggcgcgtggccgatgatccaccagaactacagctcgcaacaccacctgccgatgctgctcgacgtaatgcgcggcatcgcagcggagtgctccgaccctgacctcgacatcctgttcggcgatgcgagcgagttcggcaagcacgtggaaaagcgcatcaaacagggtctcgacaccctgcacatctcacccaaaccggagtaactgcaatgcccaaatatcgcatcgtgaaagacggccgccacgttggtgacatcgaagccgaggacgcgcggcaggctggcccgctggccgccgagaagtggggcgacggcatgtacgacctgtcgctgatccgcgaagtcgaagacgacgaagaggccgagtgatggacgcggcgacggcgctctggattctctcgaacctcacgctgttcgcagccctggtcgcggagaagcatcgcaaccggaagtaccgtgaggcgatccacgggttgctcgcggacgagggctacgtcgaaggcgagccgcaggcgtacatcaacgagacgctgcgcatgacggagcacatcggcaacccggaaccgagtgctcacgacttcgcgcacgccctggtcggccagaaggggttccgcaaggccatcgcacacgaagagctgcatcgtgtgtacctcgaaacgtacggacggggcgcacgcaatgggtgaactgccgcgcgtggggacggtcaggctctaccggatcgacggcgaagagatgaccttcgaccagattcaacgcaactgcccgcacgtcacggaaaagatgctgcgggaccggctgttccgaggggagcgaaagatggcccggctgagccgtccgccggattcgcggaggggtgttgacaagccccggagctggcgatagagtggccccgcagtagcgattttacttcggactccccaccgggtaagatcgagctgcaacgagacgggccgaggccagtctcccggtagcacggaagcgcgccccctcgcgacgaagtgcaaacccggcgtccggtgccacgatacggcaccccataattctcacgccgagagacaacatgaaaatcgaaatgcaagacctgccgaaagtccgcgacgcgctcgacaagttgatcctcgatcagcacaactaccgcaacctcaccacgcacggcgaaccggaagacaagctgcgcgtcgtcggcgagggcggccaccacgagggcgagctgacccgcgaagagctggccgaaatcttcgagaagcgtatcgaggaaaatctgaagttcctccgtcagcgctaccagatcgacttcgcccccgcgccgcagctcgtcactcgtgcggttccggctccgaccggcggcctgaccgaagccaacgaaaacgatctggacgccgaatgaactaccccgtcatcccgaggatcgcacccatgactgcaccgaaagtctcgcgtcgcttctacaacgcgctgcgcctgctcggcctctggttcctgttcgtcgccgcgttcaagcagtacgcgcgcttcatcaagccgagccgcgtcatcaccctggatggcgtcaacggcggcgagcgtcgaccctacctgacccgctggcacctgatcccgcgcaaccgctggctcaacctgtacctgcacaagttcgtccacggtgacgacgagcgcgctctgcacgaccacccgtgggccagcgcctcgctcattctcgaaggccgctacatcgagcacacgagcgagtggttccctgcgttcgataacaagcagatgggcgcgtacgtgatggcgatgagcgacctgttctcgccgcaggacggccgcacatacgtcgagggcagcgtgaccgtgaacagcggcttgcgcgaaggcgagaaccgcttcgactacacccagcagttccacgctggcgacttccgcaagctgccgccgacgcacatgcacatgatcgagctgttcggcaacaacaccgagccgtgctggacgctgttcatgaccggctcgattgtccgccgctggggctttgcctgcaaagacggctggcgcgacttcaaggaatacctgcaagacagcccctcgcaccctggctccacgctgggctgcgagtaaccgaatcccgcaagggaaccctgctcgcatcccgcgagttgtcgacaacaacgcaatggagatacccgatgagcgccaccgctgaagcagtgaccgaagcaaccaagaaggcggcgaagaaagcccccgccaagaagaccgcaccgaagaagaccaaggccaccggcacggccgctgccaagccgcgtgccaagaagctgatcgccgccaagaaggccgtcaagaaggctgcgccgaagaaggtcgccgccgatgctccgaagcgcggccgcccgccgggcaagaaggctgcgaagaagaccggcgtgcgccggggcaagaagggcgcgaagcagttcgcctacctgctgctgaccgcgcaggaagacggcacgcagaaggcaggcggcatgcagggtccgttcatcaccgaagccggtgccctggaagacgcgagcatcatggccgacgacaacacgaccatcgtgctgttccgtgagaccaagcgcggcaaggtgcagaagcagaccaagttcgtcgccggtcgctaagtcggccttgaccgagtagtacaacgagcggccctgtcgaataccggccgggtcgctttttcatatccgcagcaaggacactcatgaaagccgacatcaatatcaaccgcagcctgcgtcgcgtgttccgcacgtacgacaaggagaagcagctcgaagcgcaggggaaggaactcagcccgtggcgcaagaagcagctcgcggcagacgagcgccgcttgttcgagttgcagcagcgcgacaacgagaccgacaatcgcgccgacaagcgcggagtgccgggcaagccgggcaccggcatcttcgccacccgcgacaagggcagcgtcgaagagaagctgcgcaaggcgttcggcggcaaggtcgccaagcgcatcttgcagcgtgagcgactggccgctcgcgagcgccccgaccacgtgcgcatcttcgtcgagcaggtagtcgacggcgtaggctcgcgtacggagctgacgcgcggtgtcgacttcgcggttgtcccgccgccgcacggcgagccgacgctggtgctgcacgacgacgcgaaggtgttcgagattgagtacgcctccgactttccccacaccctgacctgagagacccacatgagcactctttctctgaagcgggaagaccgactggccttcgtcaacgccgcccacgcagcggccgcaggctacgccgagttcaccgagaccaccgcgaagtatccgaccacgctcagcaccgttgcgatcactgcgggcgtcctgtacgtcgccctgggcatcggcaacgaggtcggcgaactggccgaactgttcgacgaagaagcggtcaagcccgactaccgcgccgaccgatacgcgaaggcgtggaaggagctgggcgacgtgcagtggtacatcgcccgcatgtgcgaagagcagaagggcctgccgccgttcgccatcatggtgcgcaacgcagccacgcgcctcgccgacgcgcactaccgcgaagcccggatcagtggcttcgatctgcaatcggcgctctgcactcacgcgggcatcgtccagggtgtcgtcaagaaggccatgcgcgacggcatgcagtgggacgaggccaaggccgccgcgaagctggaagaaatgcggcaggcattgcagcagatggtcaacgtctcgttcgagttcgccgagcgcaccgcacccctggtcgactgcggcagcggcggctacgtggcgttgctgaagggcaaccgcgacaagctggccgaccgcaaggagcgcggcgtgctgcatggggacgggggcgagcgatgagcgcgcgggcgtatttcatcggcggccccttggacggccagcgcctcctgttcccggcctcgccgccgccgcagctctactcgcatgaagtcaagcaggaagagctgcctgtcggcgatccgaccccctcgcaccggttcgagtacgagaagcacttcttcatggatgcgatggacagcaccaccgtccatttctacgtgccgctgggcaagggcgcatcggccatgcgcgatttgctcgaagcgcggctgaaggagaacgccgatgggtgagtaccacgacctgacgatcatgctgagcctgccgcgcagtcgcagcgcgtggatggaagcgttcgtccgcccgggcaccggccacggctgcgcgtctctgcacaacccgttgcagcagtgcgcgtctatcaacgagctgggcctggttgttgacggcatgccgcccggcccggctttcatctccgacgtggccgcgatgttctttttcgaccatctcgtcgtgcggttccctggcgcaaagttcctgatcgtccatcggcctgcgcgcgaagtggcgcacagcatggagaccctgggcatcacgccgccgctcgatctgcgaaaggccgagaagcagctcatcgaaatcgccagcagcatccgtcacaacccctgggtgcttaccggcagtttcttcgagctgcataacccgtcgctgctctcggccatctacaagttcgtcaccgggaaggtcgtagagccgcgccacctgcacgcgatgatgaagaccaacgtgcaggtctcgctcgaagaacaaatccggcgcactgacatccagaagcagcgcatcctgttcggcaaggccaagatcatccactaggaggcaccatgaaaaccatcggcagcttcgcaggcccgtatcgcttcctctcgaacttctggtcgtgcgctgtcgttttcgacggccactcctaccggacggtcgagcacgcgttccaggctgcaaagaccgacgacatggacgaacgtcgacgcatccgtaacgagccggacgccgcaggcgcgaagcggcgcggtaagcgcgtagtgctgcgcgacggatgggaagagaacaagatcaacgtcatgagaaagctgctccgccagaagttcggcaccgagccgctgaagtcgaagctgctgaagaccggcaacgcaaccctcgtcgaaggcaattggtggggcgacaagtattggggcgtgtgcgacgggaagggcgagaaccatctcggcaaactgctcatggaaatccgcgaagaacttcgcatcgaaaaggaacagcacaatggctaagcgtattctgatctgcggcctgcccggctcgggcaagtcgaccttcgcgcgggaactcgccgcgcgcctcaacgccgctcacgtcaacggcgatgccgtgcgcgaggcggcgaacaattgggacttcacgctggaaggccgcatggagcaggcgcaccgcatgcgcgctgttgccgacacgcacgaaggtctggttgtgtctgacttcgttgcgccgacgccggagattcgcgcggtgttcggagcggacttgaccgtcttcatgaacacccttgccgagagccgctacccggacaccaacgagatgttcgtgccgccggagaacgcggactacgtgaccgaacgttgggcggacacgaccgagatgggtcacatcgccgaggcgatccgcttcatgatcccccagggtctcatgatcggtcgctaccagccgtggcacgcaggccacgcggcgctgttcgagcaggtgctcgcgaaggaaggctacgtcggcatcggcgtgcgcttcatgccgaacggcccgagcaacccgctggacggcgtagcggtcaccacgcgtatcgaagccgcgcttcagcaccgccggggctgcttccacgtgttcccgatgccgaacgtcaacggcgtgtactacgggcgcgatgtcggctacaaggtcgagcagattcgcctcactgaagaaatcgagtcgatcagcgcgaccgcgatccgcaagcgaggcggcgtatgaagtacgtcatcctgaaggccacgttcgccgacatggacgtgagcaaggcgttccccttcatcttctccgagcacctgacccactcggaaatcgccaaggcgatgaagcggcacgtcaccatcgagcttcgaccggccaacgtcgaggtcgaagtccacagcgccgggttctgcaacgtcactaaggacggcttcgtgtgcgtgcggggcagcgaaacgctgaacatcaagaaggaagagacgcgctgtgccgatgacgagcgcacgatcaccttcaacgattccatgagcatcatgctgtaacaaccggagccgagtgccatgcgcgagatgtatcaggaaatcacgttcaagaagaagagcctcgaaatgatcgaccgcatcaacggcatcattgaggtctatcaggacgaaggctacacgctgacagtgcgccagctttactaccagctcgttgcccgcgacatcattccgaacaacgagaagtcctataagtacatcacccgcctcgtcaacgatggccgcatcgccggtctggttgattgggacgccatcgaagaccgcacgcgttcgttcgaggcgcgcgggcgttggaataacccgaaggacatcctgacggccagcgccaagcagtaccacaccgacccgtgggccgcgcaggaccgccgcattttccttgtagtcgagaaggaagcactggtcggcgtgttccaaaacgtgtgctggaattacgatgtgccgctgctcgcggcgcgcggctacccgagcgcatcggttgtgcgtgatttcgcgcggcgggaaatcgaacacaacgccgacaaggacgtgctgatcctgcacttcggcgaccacgacccgagcggcatcgacatgacgcgcgacctgatcgaacgcttccagttgttcggcctgggcggcgagttcgagttgaagcgcatggcgttgaactacgaccagatcgaagagttgaagccgccgccgaacccggcaaaaaccacggactcgcgtttcgtgaattaccgcaagcgatttggcgaatcgagctgggagctggacgctctgccgcccaccgtgctgagcaacatggcccgcgacgaaatcctgagccacatcgacgcggcggcttggaagacgtgggacgatggactgaaggagacgcgcgagaaaatgctgaagcacgtcgagaagttcaaggggtaagccatgatctacatcatcgccggagacgacagacaggccgaacagtgcgccgacatcaaaggcgcatcgcgcggcgagtggaagcgggtagcgagcctcaacgacatccggggccgccgctgggacggcatcacggtgtatgcgttcggtacgttccgcacgcggcacatgttcgagtggcgcgagatggtggaggcgctgcaacacctgggcggcaagttggaacaggtgatcgacggacgcttgacacgctgacccacgcggccttatggtcgagtcgtcgaagcgatattgcccttccagccggaccagcgcatagcgaaaaccggaatcagcagaaccacgcagtcgacacccggccaccgacgagagtcgcgccacccccggaaggccccgtctcagcaacggggcctttcttttgcggtcaagaccaaccggggcaagaccaacttggccttgaccgcaaaagaaaaccccgggtgtttagtccggggtttccagttgcaggctgagcgccgattctcttcctgcgttccctaccgaggtgccgatgcaacgcgaagtgcgaccagcggccctaaagctatccccgaccgccggggctgtcaactaccggcggatcgcccccgccttctcgtacccgtccaggcaacgctcctgcacggccgccagggcgcgttcccgcttcaccgctaccagcgtactggcaacccactcggcggcccgtgcggacagccgggcgaggccgttgggccgttcgggggtgggcggcacccactccacccactcgtcagccgccggtagggggtccaggggcgtcgaggcggcctgtcggcagtccacggtaggcggtgccgggcgaacggcctgcgtgcagccgcacagggccaccagggcggccgccagcaccagggcgcgggcggtcatggcacacccccgttcgcgtccttccagcgggccagcagctcggcctgcaccgccgggtcgaccgggtggacgcagctaccggggctgaccggcttggtgacgatccggtcgcggtagacggttcggatggtctcgacggtctcgaccttcgtctgtccggcctgctgctcgaccgccgcggcttccttgtccgcctgctgggccacgtcgcggcccttcgcctcggtcttgatgtactgcgtgttgccctcggccttgcatgcgtcacgccccttctgttcgtagtgcgaggcgaagccccaccagcagagcagaatcaccacggccaggatcaacccctggcccagcctcgtgttcaacaaccagctcatagaaccccctccggccacgcgggcaacgggatgttgttggcgacgagcaacgcacgcagctcgtggatgtagaccagtcgtttcgctgaaacgtcgtcggccgcctgcgccatcctttgcgcgtgggacgctgcttccgatgcgcgtgcggcagcggcttttgcagtgtcagcttcgatgctcgccatgttggccgcgcgcttggcttcgccgatttcgttgtacccggcggcggttttgttgaaaagctcaccgagttgttcttccagctcccggttccgcttctgcaaccgctcgatcaaatcagtcttggccgcgttctcggtgtcgtcgagaatctggcccgagcgctgcctcttgatgacccaaccgacgccgccggtcaccagcgttcctagcagtgccgccacccacttccaggcgttcgtttcatccaccgtcaattcccctgtcatgttgtcgaccgcagcttccagctcaacgtccatcacgctgtttccagatcgctacgagtcgcctcagtacggagcacgcagaaaacagccatgaccagggccaggatgtgcgtgccaaccaagccccgccagccctcgaaggcggcataggacaggcagatgataaaccaagtgaacagcgcgaacacgttggaggcccaagccagccacgtcaccggccgcgtggagagcacgcgccacagcatgagcgacccgctgagccatagcattgccgaccatgcgtagaccggcagcgtggcgaacagcgcccaccgggtcggggcgggcatgggccggaccagcaaactcgcgccgaagatgaggctttgcagggcgagaatgaaacgcaccttcagcgtcgtgccttgggtgatggcgtgccacaagtcggcaccgattcgcggtttgatttccatctcagtttcctccgaattttctatgggctgctgcaagtttcacgtcgtattggttcttgcggtactgcgagccgttgtactttctcgcgacggtggcccaatcgccgcgcttcaaagcattccacaactcggtgtcactctggatgaacgccaccatgaggtcgagctgcgcgccctcgctgcggaacatgcggttgatgaaatcctgcaacgatgccgctccgactttcttccagttgttgcccaggatttgcgggatgccccagctcgttgcgcgcagtgcggcgtcgcggtcgagcgccacggcctgttgcagtttgccgtgctggctggcgtagctgctgtagggaaccgcgccccacaccggattgctcaggtgcgggtggctcttgtcgaagcggccgcccgtgtactccgagaacttgtgcggctcgaacaggatcgtgacctgcccgtcgtcctgaaacccgccgcgtggcgcttcgacatcgagaatggcgcgcaccttcgcctgggatacaacaagggccttggctgcgcgtgcgatgtcagcgtcggtgagcttcttcgagtcggtcatggtgcttctcctgattaattaagggccgggttcggacgtgaggcgatcccacagtaccgagttctgcatgatgccgccgtccgagtcgaaggcgattccgtagtacgcctggacgccgggcatgaggttgttgaactgcacgtagccgttcgcatccgagagctggatgtcgatcagcgtatgcaggcggcggtagaacaaagcgacgcgcacgttctgcaacggcgtgtcttcttgcgtatccgggtctcgctgcatcacgcggccgcgcagcttgtacgtcggcagcacgttggtcgaccccggagcgccccaccatggcgggacacctcgcgtcgacttggtggtctgcaccttccgcaaactggccggaggcgcgcgatagacctcgatcttcttgaccgaatcaaccttggttactttgtcccagccgatgcggctgcggcgaatgaacgcggcgaggcgtgcgggtgcaggcggcgggtcgatgacgttgatgtagacgttgcgaatgccgcccctgaaaatatacgagaagcccaagtacaaacgaccgccgattgcaaacgtgctgaccgcgtagttgtagttgcgggcgtgaggcaccgacgcttccactgcgccgtccaccaaaacgctcagcacaccgtcccttcgacggaacagcacggtgtgccagttgccatcgttaaccgcgctcgtcgtaccgattaccggcgattcgttggggccttccgccgtccagatcaaacgcccctcggtgctgaaatacacctgccacgtgcttccgctgccggtcaggtagtctagaacggtggagagcgtactgctcgtagtctggatgtcgaaagcgatgtcgaaatctttcgtgccgagcaggaaatcgccgccgctgttcgtgtagatcagaccgtcgcctataaaacgcgccgctccgtcgatgatgatcggagcgacgctgtagccgctccaaaatcgacctgtagcgtctgcgtacgaagtcgatccttccggcgagcttaggggtaggttggcgagcagcatttcagtttaccgatcccaggtgtcggagatttcaaacaacgcggagttctggtagtgcacccgatggaggaactgtttccctgccagttcgccctggccttcgaccaacgcgccatcgggcaggattccgaagtagtggcagtgaacccaaatgccgggcatgatcccgcgaatactgtagggtccgacattcgggttgtgcgcccacaccggagagaggtacagcccgccgtcagggccgtgaggatagctgaggttaccgttgccccaactgctgttgcccttggtcatatcgttgtgccagccgagcgtgatcgggccgcccaggttggtgaagtcacgcgcaaccgaaaggcggtagcggttcatcgccgaagaaatgctgtaaccctggaacggatactgctccgaagagttggggctgtcgggcgagtcgttctgcaacaggatggtgtgcgtggtgtcgcccggcttgaacgggatgatgtcgccgaacgcgtagcactcgcggtaatactgcgtgccgctctccgggtaagtggtcagcaacaaccagaagaacatctcgtctgcgataatcgtccacgggcgggggttcgccaccgagccgctactgtagtgggtgaaccaattgccgccctgcgggttctgcgcgagagtcgggaagggcgacggcgagccggtgttgacatcggtcatgacctcgtagccgacgaccttcgccttacggtagctggtggcggtgctggtgtcgtccacgcgcaggtacatgccattggagccagggccttgcttgaatgcggccacgttggtgccagcgaacggcttcgtccagcccgcgcccgccttgctgccgtagccggtgacgaggcacttttcgagcacgttgatgaggtcgccgggcgtattgccgcgaaggaccggagcgtctgcgtcagaagaggaataaactcgaacagtcatttcagaacctcacatagtcaagagaagcatgtaggaagacttgcgcaactcgttgccacctccgtcatcgtcagcaccgaaaatccactcgatgttgggcgacagcggcgggttgtactcgttgcccttgaacacccaaacgatgttgggcgatagcggcggggtgtattcgtcggccatcgtcagattccatccaccacggcctgcacatcgtagaagccgtcgtcatcgtcgtacacgaaaccgatgcggtcagactttcccggcgtggaagtggcgttgtaggtcgagatgaggttgttgaatcgaacattgttgctgaaggtaaccgcacggccgccaacagcgtcttgcttcagcaacagaacgcaaccctggccgtccagagcaccttccatgttgatctgcgtgttggccgtgagcgtcactcggatttcgtcgtacgagttccagtcgcagatgaccgagccgctggtggtgtcagtgattctctggatgcgacgctgcgatgggatgccgggcggcccctggataccggggtcacccttcgcgcctttcaacgacgccagccactcagcttgcgtaccggcgaatccgttcgccaccgccacctgatacgcgctcaggccgttcgcgccggttgcgcctgcgttgccttgcgggccgcgcagggattcgagcgacacgaggttgatccagttctcgtcaccgacgtagcgccagcggatgtagccgccgcccgtaccgatttcgatcagccgcccctcgaagaaaccgatgctgttccagggcgtcacgccgtcgccgatcttgaacttggtctcgtccgaagtcgcaccgagctgcacgccgatttccccggccgcgaggaccgggttcttcgattgccagttcgccgctacgtcgcggcgctgccacatgcgttgggcaacaactacctgggccattacgcgccgcctccgtcaagaacgtactccggctcgtcgaccgcgatggtgttcgtgatcgtgccgctggccggagtgtagctgaagtaggccacctgcttcgaccacgaggccaggccctcccgcatcgactcgatttcgatgcgcatgtctcctgctactgcgaggcggatggtcgcggcggtagcagcgtcggagaccgcaagcgcttctgccagtagggcgttcgagccggtgtagacccggatgttgtaggtcgtcccttcctccggcgtacgtgacggatcggcctgggaggcgatagtcccgtccaggcggttgcggtgcgcccaggtcaagatcatgtccccggtgaaggccgatccagcaccgaccggcgcggcgttgacccggattcggcccggcggcagcggccgcagagagcgcgagttggtcgtgaccgtgacggctgctgcgaggttgatgtcgagcgacgacgacacgttcttcggagctagcttcgtgttgaccgtgacgttgcccgagtagccgtcgacgttggtcgtgcccgcaccttcggacaggaagaacacgcgtgcgccggtagcgtgatcctgcgggatggtgtcgagcacagcgcggtacaccccggtgatcgtgaacgtgccgttgccgttgtcgacgatgttcttccatgccatgagttcgttgccgaccagcagcaggttctcgcctgcctctcgcgaaccatcggtgcctgggtcaagaccggtcagcccgatggccgacgacacggtgaagcctgcggtgtcgacttccgggccagtgcgcgacagaccggccaagagaacagcagacggcgtgtagccctcgaccacgttggtgatctggtaattcgacgcgccgctggggtcgctccacacgtcgtagccgatgacgccgttgctcgcgggcacgcccatcgtgatgagaaagcgtcggctcatatcgtcagcgccgaatgccggggcttcgatcacgcgctgcgcagcgaacggtgcgagagcagtaaccggcggaacccaatcacccggacccggcggcacgtacgctacagcgttgacctcgaagatgtcctccatcgcggtgatcttgatcgccgggtcgtccagggtgccgtagctgatttcgatcacgcgcatgagcacgttcgccagtccgcgatccggcttgcgcagccagaagccggagccgggacgcagcttgtagccgatgcggttgagcgacatcttcgccgagaccagcggcgacgctttcattttcgacacgcgagcagcggtgttcatcgccgcagtgtcattgctgaagccgaggtagctgaaggtctccgcgtcgatcatgccgccgcgcacgtcgatgttggcgaggtcttggtactgcaccggcttggtctcgaacgaggcgcggtcggtgtactcaacgatgatcgtattcttcgtcatctcccaggacgtgcgcgagaagtcgaagctgtcttcgaggatattgctgtcgtcaataaccagcaggtcgtccttctcggcctgcgagaactcacgggccagcgtcatcgtgtacaggccggtgaccggatcggcgtacaccacggcgtcagcgtggcgcagcacttcggccaggaggtctttgccgagcatggccgactgcaccagcatcgaaatgcccagcgactcttcagccagcaggttgccgcaagcgcggaacgagtcaacgtcgatcttgtcttcagggattttcatgccccacatgttgttggtcatcaactcatacgacgcgcacgcgatattcgcgtcgccgttgacgttgtggcggccgccggtcaggccgagctggttcgggcagcggcgagcaatgatcgagatgggcggcggcgtgtcgctgttgccgaggtagcacttctccatgaccatatgcaccaacgggcggaacgcggacatgtccggttcgttccactggccggagaggtagttgttcgtgccctgcgtgaacgtgccttggtacagaacgcacttgccaactacgccgctcggcgggtcgccgttgtcgagaatggacggcgagcagatgtagaactcgcacttgtcgccgacgaactccttgctcgcgacctgaccggccagccacgtgtccttgtacttgaacaccgagcgcacaaggtcagccaccttgtcgtctacgcgcagttcgatgaactcgtctgccgggccgtagccgaacacgagctgcacgcccaggtagtagttgtacccggtgacgatcttcttcgacgagaaccagccggtcttgaccttcttcttcagcgtcacgacttcgaggtcgccgaaccacaccacattcggccccatcatcttgcaggtgccccaccacaccggtacgacgcgcgaggcgtccacggtggggaacttgaagtcgcccacggccgatgggttcgggtcgttgaacttctgcttcggccgcagcagctcgccgacgattgcgacgacgattgcgacgataattgcgatccaggccattaggtgatcccctgctggaagacgttgtaggtcgggaagtgatcgaacccgacgtagttgatcttgttattgaacttgcccgagcagacttccttcgtgcgtgcgcagcctgcgtacacgtcgagaatctgcccgccctgcaccgtttggaacggatacacgaccttgatcgtggcggtggctgcgtcatgcgccgtgatgaaacgctgctcgccggtctcgcggtcgacgatgaagccgttggtgtagtagccggtcggcttggacgcgaactcaggcgagccgagcgtgtagccgtccacggtggtgatgagcgcatcacgccgccacagcgacttgtcgacgccgcaaccgatctggtacagcgcccacacgcaaccgaccttgaacaccacccacggcaccgtctgcgaaaggttgtcgatgatctgcgagcattgcagcgtcgcgtcagctcccttctggctgaagctcgtcacgaagccggtgaacgcctgcacgatttccgcgccggggtcattgcgctggtacgcgtagatcgtcagcttgatagggcgaggcggcagatacggcacgtgcgcggccgccacggggttgtcgaacggcacgacgacttccaggctctcgacgttggcatcgcctgcggtctgcttcagctcgccgcgtttaatcgcttcgggcctgtaagtaatcgggccaatcgagcgctcccgcgcatcggtggtgtacgcccagcggtaacggccgtcgtcgctctcaaacaggtaaagctccacgcgagagccttgttctttgctgctttcgtattgggccagagacatatcagtcctcggtcatcttggcgaccagcatcgactcgacggtggccttggaatcggtcaggtagcgcaccgtggtggaaggagactggaagcggtacagcgtcaaaaaactgatccgacgaatatcctgcggccgcacctcttcgccgagcgcactgtcgagctgcaaccgggtcaggttgtcgaactcgctaaccagcgtaatgcgacgacagaaataccgaccattcttcaacaggatgaagatgtcgcggcgagcaggatgcgcaccgaccagcttcgcgtattcgttcgactccaccacgagcgagttctcggtgtcgaggatcgtcgccgccatcgtgaaatcttcggtgccgctcggcatgtagaccgaacgagcaacaccctggcgacggccgaggaaacgacggaactcgaaaatgtcagcgcggtcgaacagcgtccagttatggcggcggctgattttcgagaagcccgaggtggtgaaggcaacgaacttgcctgtgccggtgtctacgcgcttcgtgtccgcgctgaaggagaaaggcatcgccgacagccagttggtctccttgatgtacagctcgtgccctcggtaggtcatcgggtccgggttcatcgccgcgttgcccggcgttacgctcggctcgaagtcgaacgacatcgccatgcggccaacgcgggaagtctcgcgctgctcggacatctcttcgctcatgaggccaacgaaacacggatacacgcgcgagtcggcaggccagtcgtactccaacccggtcgtgaccgaaacgccgtcagcagtgacctgctgcacttcgcggatttcgttcacctcgtcgtcgagatacagcgccaccagcgaaccgggttcgagcgacaggccgaaggtgttgaaggggataacgagcgagcccgcttcgacggctgcgtcggtacgcgactcttcgccccaatgcgggacgccgaagaagcgggcctgccatgcgaacagcagattctcggcgcgctgggcctgcttagaagtccgcagattgatgttgaactccaacgtgcgtcgcggcacttcacccgactcgctaccggtctgctcgctaccgtcgtccgacgacagcacccacgagcgatgcgtgatcgtctcgtcgaccggagacccccaattcggagagaacgggaagagaacgatgcggcggccggtgatcggcacggtgtagttgacgccttccacggtgaagcgcgcatagctgctgatcgtcggcgggcctgccagttcgatctgaacggtgaaatccagctcacgcagcggcggcatctcgaacggaatgctgacgcccgccgggggagacatcgaaatgcctgcctgcgggccgagcacggccgactccaacgtctgcggcgtgacgtaggcattccaaaggatgatgtgccggacctgcgtggacagcagattgcccgcatccagggcggccgggacgatgaagatgcggttgtagtagtcgtcgaagaagctcgtcatcttgcgctgcgccgacacaccccggtggttgctcgaatgcacgtgccagctaccgtagcggccctgcaagaagcgaccgccgtcgtagctgtcgaacatcgacacgacttcagtcagtttgttgaggtcatcactgagcatcgggttgtcgatgccccgctcaaacgcgctccccatttgtccgatacgtgctgccatgtcacggccccgtgtagcgaatggcgtaggcaaacgtgccgctgtgatccgcgccggtcgaccacggcacgccgttgcgcactgctgcgttcttacggtggaacgggtacaccttccagcggtcggtgccgtaggtcacgatttcgccggacaggtggttgtcgttgcgacacaggcgcgcgttttgcaggtctgcggcgatagtctgccccttcgagagacgacgctgcaccgcgagcaacggcaggagcacggtgctctggttgaactgcgacggcagcgattgcagcagagcggcaactggatcgccgctgcccatcaaatcaccttcgctggtccctacgcgcttccacccggttgagtccaggccagtgtggatgtaggagcagcccaggggcgcgttgtatacctcgtggaacaagccacaccccatgccgctccacccgaagccgacgtagctatccgacgcgttggtgtacacgagatgggttgccgcctgcaccacgtcactgcggaacgaaccggtgagccacatgccggtgccgccgacctgatcgacgcgagacttgccgaacgacaactgctggtacttgtcgccgttgtaattgatgacgaggtagacctcatcggtttcctcgaacacgtgcaggtcataggtcgccgggaagttcatcggcgagccgctgaagttcatgattttcacgccgtacggagccgcgcccggcagagggaacgggtcgacggcgctgccggtgcctgcgaacgctgcgatctggtagatgtcggtcgccacgaggcggacgtacatgccgttcttttccagcgtgccgtcgccgttgagcgcccagccgtggttctgaagcgccgcttccatcgacgccttcagcgtcacgaacgaagaaaaattgccggtgtagaacattaggtcatctccaagccgatgaagctgcgccagtcggttcgacccacgtcttgcagcatcacgaatgcgcggccgcccgccgcaaggactgcatcgacgtgctcagccacggtcatgccggtgctgtccaccgcagtgccgccgacctgcaccacgttctccacgttgttgttgaagccggaaatctggtacacgccgtccagctcgccgaagacatttcccgcgtaggtgtcgccgctggccgtggtggtgtacaggatgatcggctgcggctggtagttcgttcctgccgggaccagggagcggtggcttacgtccgtgtccaagtagctgtagttcgccaacgcgttgtagccgttccacgagttcgagccagccgcgccgttatagaacgggaaatgcgagaggcgacgccacgtgcctacctgatcgcgcagccacagcagcgaaggacgctccggggaagacgcgccgctctcacgaccgtgatacgggaacgcgtagtcgaggtccgagaatcgcttcgccgctgcgccgtcgaacatgcccgcgcacaccagcggcgaggggaactcgccggggcgggaatacgggaacatcttgcctgcatagaagtgcgtgtagaccggcgtgccgactttgaagcaaccggcgatgcgctgggcgttggcagtgatgaagtaggtgacggcgttgttatggcacggcacgccagaaagccgcgcgcccggctgagcgtcgaacgtgttagccgatacgaagccggtgaacacgcccacgaggatattgtagtagtcgccgctcgtgctgaagtaggtacggaagccgatgtagatgtcctccgttcccgacaagcccttcgagttcaaaatcagctcgcggttcgtgcctgtgttgacgtagcgcagcgtcgtccatccgttcgcttcagccagggtcttgatcgcagcgagtaccttgtagtacgcctcgtcgccgctgccgcccgtaacagttccgattgcgtgtcccatgttggttcctttaattgcccaggagtttcttgaaggaggctcggtcagccttgatgacgttgaagatcgcctgacgaccagcgcgggtgttagcaccggccgcaaccacgctctcgctgtcgatggtgttgatgatagacaggtctaccggggccgggccgctgccgccagccatgccgccgttgaagcggtggcgcggatcgttttcggtcaagacctcttcgttcttcttcagcaccgccggtacttcgtcggccgcgaagcccgccacgccgcccgtgtggtagcgcaccgcgctctcgtagacgtagctcggcaccgcacgcttcttcgacgccgcgccgaccacaccgccgtcatgcttcacgtagctcatcgccgcgttgatgatcgcgccccagccgccgctcgcgctctccgaagcctgcttcagcgcgttgaagatggcctgctggataatcatctgcgcgagctgcacgagaatgtcggcgatggtgttgagcacgatgtcgccgaagctcttccatgcgtcgcccgcactctggatgcccttcaggtagtcggacatcaccgccgcgctctccatgaaggcgttcgtgaagccgttggtgaacacgtcgacgatcttccgcttagtcgccgacatctcgaccgacatcgccttgatctgcgcattgaggttttcgaggttcgcgcgagcagcctgggcctgtgggccatcgcccagcgtagccatgaactcgaccgccttcagtcgcagagcttcgagctgcggcagcagacgagcgttgacctcttccatctgcgcggacgcttcgcttgccgtcagcagaccggcttcctgcaaggtgttgatcgtgtcgatggacgtgctgcgctgctgcaacagggtgttgatgcgagcctcgtagaactcctgctcggccaactgcttctgctgcttttcgaggtccggcagtgcgtccaggccgcgctgcgcttccttcttcgcatcgggcacgtttagcttttccgcctcgcggatcatgcgctccaactctgccttgcgatcagcgatcttgttgtcgatcaccttcagccggtcttccagcgtatccgggcgcgcctgggcgatgtcgctgtcgatgtcgcgcagcttctcggccacgtcttcttccaggcgcacacggcgctcggccagggcggcgaggcgcttctcttcggcctccttcttcttgcgcgccgcttcggccgccttcgctgccttggtgtccgtgcccgcacgctttgccgctgcgtccgcctcggcctggatgcgcttgaactcggccgacagcgcatcgttctcggtcgcggccgccttcgacttcgcgatgccgaggtcacggctggccgatgcgaccagctcgcgcagcggggccgcacggcgttcgaggttggcgagctgcgcctccatcgccttgccctcggcctcgacctgccggatagcctcgaactgcttcgacggcagattggcgtcgccttcccgagtgctctgcgcagtgcgaatcgcgacctgattcttgcggatggtcgtgttctgcgcgatctgatcggcgaggttcttcttctgctcatcgtagatcgtgagcaagcgctgcgctgcctgcacgcgcttttccaactgctcggtgttgtcgcgcgacagaactgcgaggtttcgctcggacgccgcaaaaccacggttgagttccgtgacggtcttctgcacatcgagcttgtcgttgttcgacttcagctcgcccttcatctggaaatagatcgggatgatgacgcccgccgaagcgattgccagcagcgccgcgatggggccgccgatcagcgccagcagcgaagcgcctgcgcgaccggcagacgcggccgtgcccgcaccgagcgccgtgttgagcgcgaccgtggctgcacgggccttcaggatttccgtagcgagctgagtgaagacgatggcgatgcgcgctgcctggatcgccagcatgatcgcgatcagctccttgaagttccgcacgaggaaggcgacggtgttcgctacggtctcgatcaggccgtcgtactcggcgaatacgtcgatcagctccttgcccgcttcagcggccgcgacgaagaccttcgtcagattcgcagcgaacttcttaccgtcgtcgctcttcaggaacttcgtcagatcgacgaacaggctgcgcagcgcagtaccgaggccgccgtcgatgatttcacgcttcagatcgccccacgcgttcgacatgcggttaatgtcgccgagcaagctgttcgatgcggccttggcctgcggaccataaataccgcgcgcagtttgcgccgccagcagcacgaactccgccttaacctcgccgcccttttcgagcatcttattcagctcttgcgtcgacacgccgatagccttcgcgaacaaattgaacgcgccggtcatgcggtcgccgagctggccgcgaagctcttctgcctggatgtagcccttcgagaaaatctgctccaaggcgcggaacgcgccctcagtctcttcgccactcaggcgcaggaccgtcgccgcttccgtgaacgactcgaagatataacgcgttgcttccgccgacataccggcatcgcgcgcagcaaccgagaaccggctgtacgaatccgccaacgggccgaaggcgaggcccagctcgtcagccttcttgcgcagatagtcgtattccttcgccgccgcgttggcgtcgcccttgtttgcgatcatgagacgcgacattgcgcgctcgcgatccacggcggcgtcgacgctttggttcaccagattgatcgcgccgaacacgcccacgtaggcagacaccagcgagagcacctgaccacgggtacgctgatacagcgacagcgcggtgcgctgcccggtgttgagcgcgttgagctgcttgctggtcttcgcggtcgactgctccaactgcgtcatcgtctgcgcgacctgcttctggccgttcgcaacgcgagtggcgttctgagcgaggcgctgctcgatgccgttgaggttttccagggtgatgcctgcggccgccgcacgctgctgcacgcggttgaacgcttcggtctgtcgacccaggtctgcctgggcctgccgcagtgcggcctgtgcgcgttgcagcgacgccgccagctcgtcgttcgggcgatccgatcgctccacggcttcggcgtagcgcagcacttcctggcgcgcttcctcgaaccgctgctggctggcggtcaaggccgtgttctgccgcgcgaggtcatcggcgagaccgccttggcccttcagcgcggcggccgcttcccgcaggcggcggctctggtcggccagcttctcgatgccgtcagcggccttcagggcgtccggcgtcagggcctcgaactccttgtcgagctggtcgacggccttttcgagctggtcgagcgtagcgaccgcctgcttggccggttccagcaccgcctgtacgcccgctgctgccccgcccagggtcgacccgctacccacggcaggggcggcggtagcgcgggccgcctgcgcagcctgcgtgccggtggcgcggaagttcgccccggcggccgccgccttctccttctcgcgggccagggtgcggtagacgttggtggtcagctcgacgaagcgctgctccttccgggcctgctcttcgcggtccttcgcggcctgggcaacagcagcggccgaatcgcgggcggcctgcgcctgctgccgttcttcctgctgcgcgagttcctgctgctgccgcacttcgcggacagcggtgtcgtagcgctccatgttgtcggtcgactgccggtacagcgccagcgagttgttgaccgcactgttgagttcctgctgcgactggctgaagcgggtcgtgtcgacgcccatctccttcagcttcgcgcccgacgtttccaggcggcgctcgttattccgcagcgacgcgtccaggcgagtgacttcactgccagcggccttcaactgctgggtgaactccttcgtcggcttctcggtgttgtaatactgctgcgcgagcgtgttgaggttttcgcgagcacgcgcgagttcttcgcggaggctgcgcacctgctgctcttgctgagcgtagccttccagcttgcgcgagcggtcgttgagcgacttcatgatagcgagcaacttctgctgctcgcccttcagactctcgaacgaccgctcggcgagacggttcgcatcggctacttcgttttggttttcggcgactttgcccagctcgtcattgagctgagaaatggttttcgtactgaggttcttcgcacgtacgatcagttcaacttcgttctgagcggccatcgcctatagctccgagatttgttccttgaatgcctgcgcgcccttcttgctgagcgcggagccgattgcgctttgaatcaaaaccgcttcagttctaatgcggttgttgacacgctcgcgcgcgagttccgtttctacgatcaacacacccagcggatactcgcctgcgagagcgtgtccttcagcggtcaggaaggagactgctgctcggattccgagccaccaccctgcgaatcgctcgattcgagatttttgtttcgcaggtgcggcaccacgctttttgctccgcgaagtgccgcttggacgtttcccaggaactcgcggaatccggcctcgtccttgaaggtaagttcggcgatggcgcgcatgcacttgatctgcgtcggcgcgtcgagctgcatggcgaccatccacgcttccggctcgtgcgcggcgtacgcgataacgcgtgcgatgaagtccggcatctgcaccatgagcttctggccgatctgcatcatgtcgacttcagcgaggtcggtggctttcttgacaccggcaccttcaacgatgtcgaagatttcttccatgttgtctttctgcgcgatgatgattccggccacgtcgttggcgttgaggccgaacagcacgatgctctgctgctcgtcatccgcgcccaggtacgggacggtgatggtgcgaaggcgaagggacgaaagggacattggcttcctcggttgctggcaagaaaacaggccgccccctttcggagagcggcctgtcgaagttggtcttggccttcttggtcttgactaagttggccttgaccgcgtttgacgcgccccggttacgccacctggggacggccgtcgatgtagacggtagcgtagccgtccagcttcaggatgtcgaacgcgaagctgagctgctgccattcgtcgcccttcagggccagatcgccgtccgcgcggagctgcacgtagggccacaggtagtcgcggcgcgggccggtcgggttgtaggagacgaagcgcagcgcgccttccacggtggtgccgtcgccgaccacgacctgcgagcgggtcgaggcggccgcgctgtagttgatggtgaacgcctcggtgccgtcgatagcgccgcccgggaccacgtagagctggcccagctcggagtcgacggtgtagtcctcgttgagcgtgtacgggacgggggtgcccgcgccatcggtgacgctggtgatggtcacgttgcgcacgccggtcgggttcgccagcgactcgccgatctggatgtaggtgcccggcttgacgcggttggccggaaccacctggacctgcgcggtgagggccgcctgcgccacgacgctcacgtcgcccaggaaccacagggccacgttgtcatcgctgatttcgtcggcgatgaaggtgccgctgtcggtcttttccagaacgatgctcttgtccttcgtgcgaatgccccggtcactgttgaagtgatcgaggttttcgctctcggtggtgaggttcagttccggggtgttgcccaggtaacgctcgccggtcttgttgcgggtgcccggtacgaacttgtcgaaacgcagttcgccacggccaagggtgtaattctcgctgcccattgtggtctccttcgggtggtgttgcaggggttaatcacgaatccagtacgggtctcccaccttctcgacgagttccattcggaccctcatccagaagtacgctttgtcggattgctcgtcgggaggccgaacaaccccgggttcgatggacagcgtgtttgcgagaccaccgaagaacccgtcttggttgcgcggggtaatcaacttccccagcgccttttttacgtcgcccatgagcagatgtgccgcatccgtctcatcgtcgccctcggccagtcctgagttgtcagcccagccgttgagcaggtaaatctgatcgtacttgtgcttctgcccgacgaacccgccgatagtttccggcaagcggtcggggttgaagttttccagcaccgccacgcccggcagcttcatctccttgccgaagttgcgcttgtcacgacgaaccatcgcgaggtcgaagttgtagccgttcgccagggtgatttcgctcttcaggtaatcgcagagcgtcttgaccagcaacagtcgcttcgtatcagccacggttcaatctcccgaagttgcggaggaagctcgattcgagtgcgtcacccaccgggccttgcacatcgaaccgaacatcacgaaatacttgatcgacggacggaccatacaacaggtagaggcttccgctcacgttgaccgcctgcttcttgttcaagccgccgggcagctctccctgcttgttgagccgcaccgcaataccttcgttcgagttctcggcgtcgtacacgccgttgccgcgccgcagcttgatcggaaatgcgccggggatgcgcttcgatccgccggtcgcggaaaccttgactcgaacgtagccgcctttgccgagcttcgcgccctgctcgaactgagccagagaggtcggccggtgacgaccggagatgacgcctacgaggtcgcctacgcgggccttcttcgctacacgcagtctcgcgcccggatcggtcgcgttgccgatgtagctcgccttgaacgcaacctgctcgcgaatgcgacggctgctctcggcctgaccgaacgtgatcgcttcgttgatcgcaacagccgatgcgcggtcgaccgtttccggtatgccgctcaccatcttgcgcacgtcgtcgagtccgttgatggtcaggccgatggtcatggagcggtctccgttactgcccacttgacgtagcgactgtcctcggaaggatgctccacgtcgagtttgaaagtcctgttgagctgcgggaaattaatccggttgccctcttctgcgacgatgccgtttgccagcagctcgcgagtgtcgatcacaacgtagtccacatcgtcgacggtcgtcgcgaagccttcgcggtcgaggtcgccgtacgtgcgcaccttgtagtgcaaacgagcggacgtgtccgtagacacgccgcccgccgaacggaacagggctgggataccgaacgtcttgtgcgtcacatcacgcgcgcgttgtttgatttcaagccagcccatgttccgtctcctagcgcccaggcgcgattactgctgcttcttgccgtcgttcttgtcggtcgtctcgaccttcggcggggcggagccagagctggccggagcctcgtcttcttccttcgccgcgtccttcgccgacttggcgtagccgttgtcgacgagctgcttctgcaacttggcgtcttcggtggtgaactcctggcccgcctggatttcctgcatcgcggtgcccaggccatccagggcatcgaagtcgcccttcagcgccacgcgagcgaccagcttcttgccagcggccgcagccttggtggtcttcttgtcgtcagccatttctacatctcctgttgcggggttgattgggtggtgtaaacagcgcggcccggcgaaccgggcgttgctggtgaaacggccttacgcgacgacgcgtgcgcgcagggtgcagttcggacggctcgggatcatgagcggcgcggactgcgacagcaggtagatcacggacgggtccgggttcttccacatcttcgggaagatgtcgagcgcctgcaaaccggcgtcggcatccatgatcgcgccgaaggcacgcacgccgtcgaagccaccttcagcttccagcagcacgtcgcgcgggtccatcatcggctgcatggtgccggtctcgtcttcgtacacatcgctgtacacgtagatgttgaacgcgccgatctggcccttgtactccacgctctcgcccaggcccgggccggtctcggcttccgacttcgagccgcgacgggtttccagcagctccttgatggccgggtgcttgcggaacgccttccaggcggtgctgcccatcgtgacgcgagtgaccacgaagccttcagcttcacggatacgcgcggcccaatcttccaggtcgtcgtccgggttgctgttgtcgtagtcgctccacgcggcggtgcccgacaggatgacggtgtggttggcggcacgaccgaagtcgatggtcacgctcgggtagtcttcgcccgacacggtgacctgaccgtacagcgcggcctgcgcgcccatccactcgaagcggcggtaaatctggttgcgctgatcgagctggtacgcggccacagtggcctgccagcgctggcccggggtcatgtcgccggtcagaccttcaccggccaagcgacgcagcatgcggcccggggtgaccgcatccttcggcttgacgtaggccggacggaaggtcttggtgtagaagccggaacgcttcaggacgcgaccctgcaagttcggagccacgaacggagccatgcgacggccgagacgcagctcgtcgaacatgatttcttcggtcgtgaagttgatctgctccttgtacagacggtcgaggaaatactgcacgggcggccggctgtcgacgatcaccttgcgcagttccgcagtgctatacaaatccatcgtgcttctcctgtttcagttgagttatgtgcgaaacgtattgcgggtgaatcgccggttagaccgggccggagttcggggcggggttgccgtacaggcgctgcgccacgatgttcgtgccgtcgaagaccgcgatcttcttctgcacggtgttggaggcagcgttgaaggtcagggcatcgacgttgaacacgccgcccgagtacgcaccttcccacttgccagcggtcggcgtcggaacgtcgtagccgaggatgtgggttgcgttctgcgaaccatcggtcgccgccggatcgtgcttggcgaacaggccggaggcggtgacgcggccgagcacctgaccgccgacgtaggcgacgccggtcacgagctgcacctgggtggtaacgatgtcggactcaccagcgaagagctggatgttgccattggcgttgctgttgtcgaccgagacgccagcgatggggccaaagttggtcattgcgatgtactcctgtgagtggactaggtagccggtttttcccgtctaggctggcgacggtgttctttacttgacggccttcagcacgctcttgttgccggtggcgtgggcgtaggcaccgagcagaccgccatcggccttctcgcccttgtcgccttcgtcttcgccgtcgccgccgttattggagatgtcagcgccgccgccggtcttttccatcgccgcgtcgagcgcggacttgccggtggaggccgacgccttcggcgacgcagcgagtgcggccttggcttcgtcgacgctcatgctgctcttgaaggcgaagtggttggcgagaccttcgcggcccttcgcttcttcgcaggtggtgatgccttcgatacgagcgcgctcgttggcagcgtggtcgaccttctcttcggtcttcttctgctgctcgacggtggcgtcggtcttcttctgctcttcgacggtggcgtcgggcttcttggtatcgctcatggtgggactcctgttttcgctggtggaagagccgaagacttcggcccggaaggaagcgactgcctcttgcggagacatgaccgcatcgaccaagccgaccttgaccgcatcgtccgcgccatagacgcgggcctgcgtgtcacgaatcgcttgttcggacattccgcgattagctgcaaccacggaaatgaacttctgccacatcccgtccaggcgcacctgcatgtcggcgcgcacgttgtcgggaagcggactataggggtttccgtcgaccttgtgttcgccggagtggatcagcgaaatggcgacgccgaacttctccatcgccttgctcagatcgacgtgcatggtgacgacgccgatgctgccggaatcgccggagggggtcgacaccatcttcttcgccgagctgcccagcgaatacgcgccagacatcgcgcccgcgttgacgaccgacagggtgggcttctcggcgcgcttgctgcggatgtgatcggccagctcgaagttgccgtagaccatgccgccgccggaatggatgtcgaatacgatgcccgccacgtccgggtcggccatcgcagcgtcgaactcgcgacgaatgtcgtcgtagccgcgcgtgccgtaccacgagtcgccgttacgatgcacgagcgtgccgcgcatcgggatgaaggcgaggccgtcgctgaaggcaaacgccttggaacgctcgcgcgggaacgagatgtcgaaggcacgctccatgagcaccacctgggcctcttcagccgccgcgcgctgttcggcggtcggcggggcctgctgaagcatcatcgacgagaacatcgtcgcgatattctccatctcctgcggtgcgatcagggccgggcggccgttgaagccctccatgatcgacatgcgcatcgccagcaattcattcatcgtcgttctccgtttcggtttcggtagccgtgtccgccttggcgtcatcgttcgcggcgctgtcagtagccttctgcgtgcccggcttgctggtcgacatcgtgaagttgagcttcttctgctcgatgaggcgctgctcgcgcatgtgctgctcgaacacttcgcgatagtccttgcccagcttgcccagctcgtcttcgtacgtcgacaggcccgatgcgatgcgcagcacggcggcctgggtttccttcagctcgtcgatctggccgcgcgatgcgccgatccagtcgcacttgatgtacgcctcgcgattgatgccctcgtagaaatgcgcggcacccttcggcatcggcagatcggtctccgggcggttgatttcctcttccagccacagcatgtagatcatcgtcgcgaagcggtcggtgatgagcttcttgcgcgactgcatgaacttccacgtctcgatcatagacgcacgagccgacgagtagttcgtcttcgagtagtccttcgagaactgctcgtagctcaggcccagcgccgcgcagatgtgccgcagcagcgagtcctcgaagtcactgccgacgccgcccggctgaccggcgttttgcaggttgagcttcgtgcccgggaacaaatgcgggatacgcacgccgtcgatagcgaggttgtcggaagaacccacgtactcggccagcgcgcccatgtacttctgcaaccacgtcatgtcgccggagccgagctgcgcgaacaccatctcgcgcggcagctccgactcgatagccgcagcaaaggtcgcattgaccaccgcgttttgcagaacgatgtccttgtagaccttcgtcatgcgcatttctttcagcaccgccaccatctgcgaaacaccacgcgtctgaccggggcgcaggatgtcggcgatgtggatgacctgcgggcggccccacggcttgaacgccggaacgcgcgtccacttcgcgccgaatcggtcgtagtaggattccatcgggtgagcgtcgcggatgtggtacgcctgggctgcaccgaaacgatcaatctccacgccacggcgcaggaacgcagtgtcgctattgtcgttcggattcgacaggcgatccgggtcgatcatgttgatggcggtcttgtacggacggccgttgcccttcaggtactccgaagtcgccagcgtctcgcccgccatgaacgcctgggccagcgccatgcgcacgagacccgtcaggccgttcttgcgcgaggcgtcaatccagttcatcggcgactcggcgtacagcatgaacttgcgctcggcgatgagctggaactcttcggcccacttttcgtcgaagccgagcgagcgccagtcgggccgagcgttcaaaaggtactggccgccgacgatggagtccttgctcgtgtcgagcgcgccctggatgtagccgtcgttgcgaatcagatcgcgggtgcgcgcatccatgcgcactttgtccggcgtgatttccatgtccggcggcagcgagggcgcggaccacaacgcggtctgtcggttgaggttcttcgcgccctcgaaggcaccgccgaaaatcatgtcgttcatcgtgcgctggaaggcggcatcgccctccggagaacgtactactgcgaggtcttggctcatggtctaggccgccttaaaagagagggcgaagggggccgccgattactgcgacccccagcatggcgttgatctgagcctggagcatggcgatgtacttcagcagggatgccgggttggcccggctgtactcaacccgctccccgttctggtcgaccacgaccgtcaccgcgccgcccatcatggcggtgtgataggccgcttgtgcctccgcaagcatggcttgcaactgttcgagggtcattgtgcgtcatcccagggtggctccgaattgaccgaaaccataatccgtagtcgggcttgacgcaaacctcttttcctgatcggcaggtcgcacaagagagttgttactccactcgtcgtaccagctctccgggttgtcccaatcgaaatgctcgaccttcagaatggtgcagaggccgaggcagtagtacgccaaatcccatgcttcgttgcgtcgcttgcctgggttcaaccaacggttcttgtcgtcgcggaactccaccgtcatctcgacgtacacatagtccggcgtccacttgttgaagaagtagcgagcaccgccgtccttcttcgcgtcgagcatgccgagcaacgtgtccttcagcacgttcgagttcaagaacagcaccggcacctcgccgcgcgcaccggccgagcgatcctttcgatccgagtcggggtagtcaatctcggcgcgcggggcaccgaacttcggctcgcccttgatgagcagcactcggttgcccttggcgctatcacgcattgaccgccagtagttgtaggcgcgcgtcgtggagcctgacttaccgccggagtcgatgcctgtcatcttgatcgacatgaagccgctgccgtcttccagctcgtactccttctcgacgacctgctctgtaatcaagtcccaatcttcctgcaccgcgtacggcttgacccacaacgtatcgcctgcgtcgtccttgcgcttcgacttctggatgttgaagcggtccaccatgtacacgtcgtagcccgcgccgctctcgctcgggccgatgccgtgtacggtcacgacgaacatgttcttctgaacgtcgacggtggcgagcaggaagcgagcgccgtacggcaccttcttctcggcccacttgatcgcgttcgattgcaggtcttccggcaggcggttcgagtcggtagcgttgaacggccagaacggttcgccctggtcggtgttgatcgtggccttcagcgccttcgtttcagcggtcagctcgaacgtctgctgggcctgcaacatacgctcgacgagcttctgccacgtgatgaagcgcgcggccggtcccttcagccagaacgacgcagtgcgcgaacgcgcgccgacgccctgcttgttgccgtcgcggtcgagactctgcccatcgcgaagccacacgccgcgtcggttcatctcgtacttgtgcttcggctcgatcacgcagccgttcttcgggcacgccatgacggtcgactcggaagccgcaaacggatcggggttcttcgtgtcccagcgcagcagcgagaacttcggctcgaaccactcgccgcagtgcgggcactgccagtagaagcagcggcggtcgccttcgttgtacaggccgccaatgccgtcagtcggcgggaacatgtgcgagtccgggcgcggcggcttccacttcgggtctttcacgtcgaacgacggcgacgactcggccagcgtcatgccgaacgagccgaacgtcgtggtgcgcttacgggccagcgggaacggcgggccgttcttctcgatgtcctgcggcatgcggtcgtagtcggtgagcgcaacacgcggcaccggcttgcccgagagctggttgatcgtcggccagcccagcgtgagcatcatgccgttgcggtagaacttgtcgaagatgttgtcgttgtcattgccgggacgcagcagtgcgccaatctcgcggctgtcgcggtgcatcttgtcgatacggcggtacgagaaatctcgcgccgtgtcgcgcgcggtctggatcaagaagaagtcggccgggtcgcagcgcgccgtgtacgcgatccagttcaagatgatttcggtcttgccgccctgcgcagggccgatgaagatgcacgactcaaaatcgcggctgttgagcacgtccatcggctcgacaaggtacggcgtctcttcattgagccaggggccgacgtacgatccttcgttgtcgaggtagcggtacttcgacgctgcctgcgatacggtcaaacgctcgggcgggagcagcaccgagttcgcagcgtaggtcagcagttcgcccaggtcgttgaaggtgctctgcgcgccctgggaaagctgtgcagacgaaaacaggtcatccatatcactcatcctcgtccagtccgatgtcgtcgaccttgatgtcggcgagctgctccttgtccttgaagcctgcgtacatctcgaagtcttccacaaggcgctggcgcagcgtcgtcaacgcgacatcggagatttcgcgctcgatgatcttgcgctgttccggcgtcaggtcggtgcgtgcctcaacgcgatccgccagcaggcgcaacgtctgcgacagcgagcggaaagcgccgacgaaaatctccatgacctgctgcgtgcgccacaggtcaccggcgttctccttgtacttcaacttgctgttctgcgcgttccaatactgcgcctgcaacgcggacggcaaatcgccagggccgacttccgcaaggtacttggcgatgtcgacgataggctccacgaggtacggcgcggcggccgacacgtggtaggtgggcgcgccacggcggtcgccggtcggacgcagcgggcgcaacttctcggtgacggtgcggcggtccaggcggaacaactgcgcgaggcgcgggatcgtcatgccgttgaagaactcttcttcgtagtcgattttagctgcggacatttttcagttctctctgtacgtcggcgacacgtcgccgcatgggttctttcagggcgtcttgcgttacttctttgcgcaccagctcgcgggtcaggtcttcttcaatcgtgcctatcgcggtcaggtgcatcatgttcacgtgtgaggcttgctggcctcggcggtgcaggcgctttcgcaactgcatgtacagctccaaatccggcgtgtggtcgtaccagatcaggttgttgccgccgcgctgaaggttgacgccgtgaccgatgctcgccggatgcacttctgcgatttcgatgtcacgcgcattccaggcgtcgatgtctttcttcgtcttcagcgagcggatgttcgggaacgcgtctttcagccggagccgcgagtgctgccacgtgcgcgccacgagaatcggcgagccgtcgctaaactcgacgatttccttcatgcgctcgatcttgcggtcatgcacgtcgatgaaggtcttctcatcatctccggtgtagacccggccgcatgcgaactgaagcagcttgccgtacaacgcgccttccgagagcgcgcggacgttcgggtcttcttcctctccccacttcagcaccgacgtgcgctcgaactcccgatactgctccaagaccttcttaggcaggatgatcggcaccgggcgaggaatgagcggcggcagcttgacgtaatcctcttcccgcagcgtgtacacgatgtcggcgacgcgcttggtgatcgacttcagcgcgaacggcttcggcgtgatcttgcgccccatgaactccttgttgaagaagtgcgcgaggaacttgctgtaggacgcgaacaaacgctcgccgccgtccatgatcgccatctgcgcccacacttgatgcaggccgttcggactaggcgtgccggtgagctggatcacgtcagtctcggggcggtgcgcgagctttaccgcgtgcttccagcgcttcgacgccttattgcggaacatgctcgattcgtcgaacacaatcgcgtcccacggcaccggcttcttgttgttcttgaacagcgacgcgagacgatccagcttatgcaccgagatgccgtcaatctcgcacggccgctccaactgcatgcgcatgtgctcaggcgtgccgtcgagttcctgaaagtcgagccagtgcgtgtgctcccagctatcgacctccgtaggccacgtgtcggacaccaccagcggcggcccgacgaccagcacgcggctccactcgccggagaacaccttgtcggacacgtgcgtgagcacgaccaccgtcttgcccaggcccatgtcgacccacaaagcacaactgccgacactctcgataaagaggccagcagcgcgttgatagtcgtccagtagcgagcgttcgagtcgttccttcatgcgaacacccactcggcgaactctttgtcgaagtagtcgatcaccagcacgaccatgcccttctttcgcagctccttgtgttcttcgatctggttcgccgtaggctttccgccggggcgcttgaactcgatgaagaacacgaagccgttgcggacgaacatgcggtcgggaacgctgctgttgccgggcgaagagaacttgtacgccttccacccggccttgcgcgccaccttgcaccacttctcttctacgtctttttcgagacggtgcttgtcggttgataggatgtcgcctctcatttctgatagcactccacggtttctgccttcgcgcggatcggcacttcgtcgccccaccactccggctgtacggtcatgtcgtcttcaaggtcgcgcgctgcaatctctgcgagcttcgccttgaccaagcctacgatttcatcgtgtacgtgcatgcggatgtccagcccgttgtcccaagcggtcacgatgccgatagccagcagctcgcgtgcaatcgcctgcaccaagttctcaacgatcttgccgccgtgcgagtcgatccgcatccagaccttgcggctcttcccgccgtagccctcgtagctgaagcccttcttcgacttgtacttcggcttgccggtcctcttgtcgatgccgaccttgatctttttccacgacatctgcggacgcaggtagtgcaggtagcggccggacggcaggcgcatgcgcaggaacggccccttcacgtccatgagaatcgggccgacgcgctgcggctccttcgtgcgcatcaccttctcgacagcacgttcgaggtcgtaccagagctgcacgatttcgtcgtactcgctgcggaagaacgctaccaccgcagccgcttcctccgccgtcatctcaatgcccatgctctctgcgtagcccagcaggccggtcttgatgacttccgggtactcgcccacttcgccgccgccggagagacggaaacctgcgccgagcacgccgggcttcgcctgctgccgcatccacttctcaaccttctcgtaggggacgccgaacatgcgcgaggcgaacaccttgtagatttcgaggttcttctgaaacacctcgatcatcttctgacaatccgccagccagccaatcgtgaccgactcgatagacgacagatcgcaggtgacgaacatcttgcccttcggtgccttgatcgcggtgcggatgcacgacgcgattgcgcccatcggcgacgacacgaggatgcggacccaatccatgtcctcggccatgatcgcttctcgcaaaagaaggagctgccactgctcttccatctctcggagggggcggggcaaattttgcacctgcaccgcgcggccagcccagcgtgcagtgcggcctgcgcctgcgaactgcatcgtgtagcacagcatgccgtcgacttcgatgtcgagcatcttctgcaacttggtgacagacgaacgcgcggcctcggagtgcagcgcgagcacttcgttcgcttcgtcggtcatgttccaatcccaatcctcgcgagccttgcggatcgaggcggatttgagattggtgaacggatagccgcgctcgcgcagccagggtaggagctgcgtgccgctagtcgggttttcgaggcccgtgatgcgcttcatgatcttcgtgaggcgcgccttctccttcgagatgacgcgcagcgccgcttcgacgtatgccttgtcgaacggcacgccacgctcgttgatgtgctggtcgatagtccacaagcgctgctcgaacgcgctcatcgggaagcgggccatcttgcgtgcagcagcgcgctcggcgatcacgtcgcggcggccatagtcgaggaacttctgccacttcaccggatcggtgagcttggtgttgcgggtgtactgcttggtcttggtcggcttacgtggctggcagaagaacttcaccagcgccttgccctccttcatcttcgccgtcttgtcgtccaggcgcagcacggtggagagcgtatcgaggtcgccgggcagcgccagcgagaatgcgtgtgccatcgagcactcgaactgctcgacgggaatatcgatgtccagcacgtgcagccagatggcgcgctcgaactgcgcgttgtgcgcggccttcttgacacgtgggttcttcaacgcaaggcgcaggcgcttcggcatcatctgcgtcttcgggaaccatacctgcggctcttcgtcgtcgaacgcgtaccacaggaacagcacttcggtcgacctgtgcgtggcgtagcgtttgagaccgtgctttttcaggtcgcattcgctgaaggtctcgaagtcgtggtgcagcgtcgagtcgtattgaggcttttgcatgcgctggtctcagaaaaacggaagcccggggacaagccccgggcgaccgaagtagcactgtcaacccgaggaattacaggccgatgtcgtcgtcatcgtcttcgtcctcgtcgcgcgaacggcggcgggagttcgacggcttcttcgacgaggaacggcgcggacgctcttcctcttcttcctcttcatcctcttcgtcctcgtcacgagaacgacggctcgacttcgacggcttcttggaggaacggcgcgcggggcgttcgtcctcttcgtcctcgtcgacatccacgtcgtcgaaatcgtcgtccagctcgtcgagcacgtcgtccacgtcgggacgcattgcgccgccgagcggatcatcgtgcatcacgtgctggatgatgtcgaagccgcagttgatgcgcttgccgtacttgttcttcttcttcatcgacttgccgttctgcgcccaggggcgaatcacagcgttgacccacgcgccggaatagatcatttcatcttcttccatcaccggctgacggtcgcggtcgaccagcgtcgggcggcggctctcgcgaacgttgacgacccaatggccctcgtgctctgcgatgtcaccgtcgtcgccgtcgtgcaggaagcgcttgtcgctgcccaccttgccgccgtcgtactcttcggcgatgaggtcggcgatcaccttgtccaacttcttcttggtgcgtgcgccggtcgccttcgggatcagcaacgcggtgcggtaggacttggttttcttgccttcatcgttttcctgctcatcggggttgtgcaggtaggcgaacgaaaggcgagcgcctttcagaaggtagcgaccatcgcccttgtccacgaggtcgttctgcgggatttgcttcttagccacggtgttgctcctatcgttgtcgagactatcgtctgtcgagattgtcggttgtcgggattgtcgaactactacgtgcgtcagtcatcaaggagcgacaacttctgcacggtcaggtcttgccgcttgtcgtctgcggagaccagacacggtttgccgggcttcgatgcgatgaagtcctgcaatttcttcttcgcctcgccgcgcagcaacttctctgcggcgtggggcgaaataaactcgggcttagagtacagcttttcgggcttgatgccagcatcgaccatgagcatttcagcatcgagttcgctggtgaagtagcgcgacttcttgcctgcaaccaccttcaggccgggcacaaactcgtcgttggcgatcttggtgtgcaggtagtcggcgatagcgcccatgcgcttgtcgtacatgctcttacgcagccacaccgccgacagctcttcgaggctcatcatcgtgaggtcgtcttcaacgaagtccccgtcatcgtccagcagcatgacgcgctggtggtagaggaagtcgtggttggcgcggcacttgtactgcaccttgcagaaccggcacgccttctcgctcgggccgaacggcgggttcttgctgagcgccagggcgaagcgcttcttgatcttctcgccgatagccagcagctcggccttgctcgtgacccacgtgctgaagttctcgacgcgcggctgcgcaatgcggatgaccacttcgtcgaagtcgtacagccagtcccactcgttgatgaagccgagcgcgtacatgatgagctggaagttgttctccggctcgacgaagatacggccgtacttgaagtcggtgacgaccagcttcttgtacatggccgctgcgtggtcgcacgtgccgaactgatcggggatcgggcaccaccgcgagatgttcactcgctgctcaacgaagtggcaccccggcagacgcatcacgtaatcgagatactgaccgacgccagcaaccatctcgtcgtcaacagtgatagcgaagcctttcgaggaatgaagctcttcgtcgtagtcggcatcaaggttgccgctatcgaacaccattcctagaaactcttccgggtctttgccggtcaacaggcaggtctcgccgatgtgatgcgcaacggtgccttcggccgcctcgtagttctcgctgtccggctcctgctcgttgagcaccaagctggccgggcagtcgaagatgcgctgtgcagacgacggcgcaaagcgcgcatgcgcacgcactgcttccttgacggcctttgcgagtttgttgcgacgtggcttcatcgtgtcctctcgaaagaacgcccggcatcgccgggcgtccgtgttacgtgcaggccgaattacttcttgcggctggccgcgcgcttgatttccttcatcgcttccgggtacttcttggccggaatgttcaggacgttgctctcgtcgagcagggccagcaccttcttgcaggcgtcgacgccgtggctggacttcagcgccttgaaggaggcgaccagctcttcctgggtcacttcttcttcgtcgtcttccaggccgaggtcgtcgtcgccttcgtcctcgtcgccgtcaccttcttcttcgtcttcgtcgtccagcgggtcgggcttcgacttgcccttgcccttcggagcggccttctcggccggtgccttcttggtgctgcccgccgggcggccgcgaccgcgcttcggcgcttcttcttcgtcaccaccgtcttcggattcgttgacggagctgttgctgctggtcccgcccacggcttcgatgatgagaacgatggcggcggcgagcttcttcgcgttgatggtggacatcggtttgttgctcctagctaggttggttttgggagtgacgggcggattgcaattcctgcccggcgagcgcactatgcgcccgtcccaacgctaagtcaataggcacgcaaagcggcttagcagaccccttgaaacccacacgccgcgaggattccatgcgccgagacctaacccttgattcactggacagcgccgacgcgcgcgtccgctatctactccggcgcatcgccctaatgctcgacccgccgtacggtcggctcaacgcaatctgcgagaagtacaactggcacgagaccaccgtgtcgcgttggcaacgtctcggatgcgtgccgcgcgacaaggcttcgatcttgcacaaagacttcaaccgtgagattggattcaatctcgaagacctcgttggcgacgacatcgcggagtgacgcacatggctggacgaccgatcaccagcgtgcttcgcaaatacggcgcgcagttgctcgaaaacggctactccatcatcccgattccgaagggacggaaaggcccaatcgagccgaagtggcagcatattgaagcaacgccgaagctggtaaagaagtgggcgagcggcgactacacgcagggcaacatcggcttcttgacgaagcacacgcctgccgtggacatcgacatctacgacgccgagatggccgagttgatggccgagcacgcgcttgaaatctgcggcaagacgatgacgcgtgtcggcatggccccgaagaccatgctcgtgtaccgcaccgacatcccgttccagaagcgcaagatcaccttcgtcgacgaagaaggtaccgagcacgcaatcgaagtcctgggcgacggccagcagtttgttggcatcggcctgcacccggagacgaagaagccgtaccgctggacttccggcaagggcatgaacccggtgagcgtgccgcacgacatgctgccggaaatcacgaccgacgccatcgacgagttgttctcggtcttcaagctcgaagcgcagcgtcgcggctggacgttgaagaagcacaacgcaccgcgcgatgcgagtcgcgacgacatcgacgacgagaacgaccgcgcactgctggcgcacaagcagccgctcgaaaacctgaccgccgatcagctccgcgaggtgctgcaatgggtgccgggtgctgacgactacgagcagtggttgaaggtcggcatggcgctgcaccatcaattcgacggcgaggaagagggcctgtcgctctggcacgagtggtccgaaacgtcgagcgaatacgacgccgactcgctggaagaaaagtggaacacgttccacgatgagatgggccggaacatcaccacggccgcatcgctcatcaagatcgcgaaggagcaccggcaggaggtcgccgaggaacagttcgagaagatcaagcgcaaggtacatgagaccgaaagcgcgatggaacttcttggcccgctggcgaagaagtggggccggttgatggagcacgactatcaggccgagctgctggtgggcgaaatccagaagcgcgtcaaggagctgaccggcaagtcgccgagcatcgcgaccgtacgcaaggcggtgaacgagggctaccgcaattccgacttcaactacaaggagctgccgttctggtgcaacgacgtggtgtacgtcgacaccgaggaagagttcttcttgatggagaaccgcgtcgcgctgagcgagcgtgcgttcaacgcgcgcaacaaccgccacctgctgtcgaagaaggatcgctcgaacatggacgcggtgccggagcagcaggcatcggccctggcgctcaacgtgtatcaggttccggtcgtgagcggctacgtgtacctgcccggtgccgagcgaatcgttgaatggaatgaccagaagcacgtcaacctgttcaacccggaagacatcgtgccgatccccgagaagatgggcggcaaggcgcggcgtgcggtcgaggcggtgaagcgtcacttcgagatttcctacccgatccagcgcgagcgcgagctgctgctgtcctggctggcgttcactatcaagcgcatggacaagaagattcgctgggccgtggtgatgcagggtatcgacggtgccggtaagggtttcgtcggcgaaatgctcatggcgatcctgtcgaagaacaacgtcatcaccgtcaacgcgcaacgcctggaagagaagtacaccgagttctacgagcgcaacaaggtcgtcgtgttcgaggaagcccgcatcgccggtacgtcgcgctacgccgtgatggacaagctgaagccctacatcacgaacgacgtggtggacatccgcaagatgcacagcggcggcttcaacgtgccgaacgtcagctccacgatcatcctgaccaatcacagcgacgcgctgccggtgtacgacgccgaccgccggtacttcgtggtctcgactcacttccagacgaagcagatgatcgagaagttccgcgcgcagcaccccgaccactacgacgacatcttcaacgccatcgcctatcacgcgggcgcgctgcgcgagtggctggaagactacccgctgcatcccgagttcgacccggacggccacgcgccgatgacggacgccaaggaacgcatgatcgacctggctcgcggcgacgacgaagacgagctgctggaaatcatcaacgagagcaccgacccggaagtcaacaacatgctgctcaacgtcggcaggctgcgcgacgcggcgctggatgcgtcgtgcggagttccgttcgggccgaagctgtcgaacttcctgaccgccaagggcttcgtctacgttggccgggcgcgcggtgcgagcggcaagctggcgcgctattggtcgaagcatcccgagctggtgatgaagccgaacctgcaagcctggatcaccgacttcatcgaactcgcacgcatcaagatgtaacctacaaccgcccaatccagggcacaggagaaacgcaatgaccaccaccgtcaaactctcgtacgtccacggtaacaaggcgctcgccgtcaagctcgaaggcaacagcgtcggcgaactcggcccgggccgcagcatcgaagtgagcctgcactcgggccagcagctcaccatcgacgagaccggagagttcttcggcagcaccaagtcggaagtgcagcagccccaggccaccgtagacgaagccacgaccgacgccgctgcgtacgaaggccgccgcgatctgccgccgggcgctggcgaacccggctcgaacgtgccggacacccgcgtcgaataaacgcacaccggcagcgaggcaaaaagaaacccccgggtcgccccgggggtttttcgttgcgccgaattagccgactcgatcctgccatgccgggtccggcttggcctcaatgcgcaatttccacccgaaccacatcgcggcaatttccggccgccggtacgcgcctttctttttccgttccagcagggtcgccttgtcggccactccttttttcagcagcagggtgcggctgatctgcgacacgaaatatttcttgtagacggcttcctcgaagtcagcgcgcgtgctctcaatttcgtcggtttcagcgatcatcggcatttctcggtgtgccggacgaatttccggcgaattaattatcggcaattctttccaatcgcgcaaggtactgtcacaagcccgggaattaactccttgtgacactgacgaattaatttgggccgatgtggcgaaaaaagcgtcactgtcacaaggtactgtcacaagccgaaacccttgtcctgcctacttttcctcttattttgtgacagtagtgacagtagtgacagtaccttctgctacacgcaggaatacgaattgtccctcaaatattagcaatggtactaatttgtggccgtttttcgtgttttctttcccggtaagggagaaggtttcagtgtcacagtgtcacaaaggcccaactcgcagtagcaaatcgacctcaaaacccttccaaatcaaccgtttgcgcggggggccgagttgtgacagtaccgcaaatcgtcagtgtcactactgtcacaagcgaataaattaattcctagcccggaaatgcggtgcagcgcgcggttcggccccttataggagacggaaatgcgaaaaaattgaaaaatgcgcgagcaccggggtcagcgccccc

SEQ ID NO: 14 - DNA, 56144 bp, Unknown
  Bacteriophage Xfas104
gggggcgctgaccccggtgctcgcgcatttttcaattttttcgcatttccgtctcctataaggggccgaaccgcgcgctgcaccgcatttccgggctaggaattaatttattcgcttgtgacagtagtgacactgacgatttgcggtactgtcacaactcggccccccgcgcaaacggttgatttggaagggttttgaggtcgatttgctactgcgagttgggcctttgtgacactgtgacactgaaaccttctcccttaccgggaaagaaaacacgaaaaacggccacaaattagtaccattgctaatatttgagggacaattcgtattcctgcgtgtagcagaaggtactgtcactactgtcactactgtcacaaaataagaggaaaagtaggcaggacaagggtttcggcttgtgacagtaccttgtgacagtgacgcttttttcgccacatcggcccaaattaattcgtcagtgtcacaaggagttaattcccgggcttgtgacagtaccttgcgcgattggaaagaattgccgataattaattcgccggaaattcgtccggcacaccgagaaatgccgatgatcgctgaaaccgacgaaattgagagcacgcgcgctgacttcgaggaagccgtctacaagaaatatttcgtgtcgcagatcagccgcaccctgctgctgaaaaaaggagtggccgacaaggcgaccctgctggaacggaaaaagaaaggcgcgtaccggcggccggaaattgccgcgatgtggttcgggtggaaattgcgcattgaggccaagccggacccggcatggcaggatcgagtcggctaattcggcgcaacgaaaaacccccggggcgacccgggggtttctttttgcctcgctgccggtgtgcgtttattcgacgcgggtgtccggcacgttcgagccgggttcgccagcgcccggcggcagatcgcggcggccttcgtacgcagcggcgtcggtcgtggcttcgtctacggtggcctggggctgctgcacttccgacttggtgctgccgaagaactctccggtctcgtcgatggtgagctgctggcccgagtgcaggctcacttcgatgctgcggcccgggccgagttcgccgacgctgttgccttcgagcttgacggcgagcgccttgttaccgtggacgtacgagagtttgacggtggtggtcattgcgtttctcctgtgccctggattgggcggttgtaggttacatcttgatgcgtgcgagttcgatgaagtcggtgatccaggcttgcaggttcggcttcatcaccagctcgggatgcttcgaccaatagcgcgccagcttgccgctcgcaccgcgcgcccggccaacgtagacgaagcccttggcggtcaggaagttcgacagcttcggcccgaacggaactccgcacgacgcatccagcgccgcgtcgcgcagcctgccgacgttgagcagcatgttgttgacttccgggtcggtgctctcgttgatgatttccagcagctcgtcttcgtcgtcgccgcgagccaggtcgatcatgcgttccttggcgtccgtcatcggcgcgtggccgtccgggtcgaactcgggatgcagcgggtagtcttccagccactcgcgcagcgcgcccgcgtgataggcgatggcgttgaagatgtcgtcgtagtggtcggggtgctgcgcgcggaacttctcgatcatctgcttcgtctggaagtgagtcgagaccacgaagtaccggcggtcggcgtcgtacaccggcagcgcgtcgctgtgattggtcaggatgatcgtggagctgacgttcggcacgttgaagccgccgctgtgcatcttgcggatgtccaccacgtcgttcgtgatgtagggcttcagcttgtccatcacggcgtagcgcgacgtaccggcgatgcgggcttcctcgaacacgacgaccttgttgcgctcgtagaactcggtgtacttctcttccaggcgttgcgcgttgacggtgatgacgttgttcttcgacaggatcgccatgagcatttcgccgacgaaacccttaccggcaccgtcgataccctgcatcaccacggcccagcgaatcttcttgtccatgcgcttgatagtgaacgccagccaggacagcagcagctcgcgctcgcgctggatcgggtaggaaatctcgaagtgacgcttcaccgcctcgaccgcacgccgcgccttgccgcccatcttctcggggatcggcacgatgtcttccgggttgaacaggttgacgtgcttctggtcattccattcaacgattcgctcggcaccgggcaggtacacgtagccgctcacgaccggaacctgatacacgttgagcgccagggccgatgcctgctgctccggcaccgcgtccatgttcgagcgatccttcttcgacagcaggtggcggttgttgcgcgcgttgaacgcacgctcgctcagcgcgacgcggttctccatcaagaagaactcttcctcggtgtcgacgtacaccacgtcgttgcaccagaacggcagctccttgtagttgaagtcggaattgcggtagccctcgttcaccgccttgcgtacggtcgcgatgctcggcgacttgccggtcagctccttgacgcgcttctggatttcgcccaccagcagctcggcctgatagtcgtgctccatcaaccggccccacttcttcgccagcgggccaagaagttccatcgcgctttcggtctcatgtaccttgcgcttgatcttctcgaactgttcctcggcgacctcctgccggtgctccttcgcgatcttgatgagcgatgcggccgtggtgatgttccggcccatctcatcgtggaacgtgttccacttttcttccagcgagtcggcgtcgtattcgctcgacgtttcggaccactcgtgccagagcgacaggccctcttcctcgccgtcgaattgatggtgcagcgccatgccgaccttcaaccactgctcgtagtcgtcagcacccggcacccattgcagcacctcgcggagctgatcggcggtcaggttttcgagcggctgcttgtgcgccagcagtgcgcggtcgttctcgtcgtcgatgtcgtcgcgactcgcatcgcgcggtgcgttgtgcttcttcaacgtccagccgcgacgctgcgcttcgagcttgaagaccgagaacaactcgtcgatggcgtcggtcgtgatttccggcagcatgtcgtgcggcacgctcaccgggttcatgcccttgccggaagtccagcggtacggcttcttcgtctccgggtgcaggccgatgccaacaaactgctggccgtcgcccaggacttcgattgcgtgctcggtaccttcttcgtcgacgaaggtgatcttgcgcttctggaacgggatgtcggtgcggtacacgagcatggtcttcggggccatgccgacacgcgtcatcgtcttgccgcagatttcaagcgcgtgctcggccatcaactcggccatctcggcgtcgtagatgtcgatgtccacggcaggcgtgtgcttcgtcaagaagccgatgttgccctgcgtgtagtcgccgctcgcccacttctttaccagcttcggcgttgcttcaatatgctgccacttcggctcgattgggcctttccgtcccttcggaatcgggatgatggagtagccgttttcgagcaactgcgcgccgtatttgcgaagcacgctggtgatcggtcgtccagccatgtgcgtcactccgcgatgtcgtcgccaacgaggtcttcgagattgaatccaatctcacggttgaagtctttgtgcaagatcgaagccttgtcgcgcggcacgcatccgagacgttgccaacgcgacacggtggtctcgtgccagttgtacttctcgcagattgcgttgagccgaccgtacggcgggtcgagcattagggcgatgcgccggagtagatagcggacgcgcgcgtcggcgctgtccagtgaatcaagggttaggtctcggcgcatggaatcctcgcggcgtgtgggtttcaaggggtctgctaagccgctttgcgtgcctattgacttagcgttgggacgggcgcatagtgcgctcgccgggcaggaattgcaatccgcccgtcactcccaaaaccaacctagctaggagcaacaaaccgatgtccaccatcaacgcgaagaagctcgccgccgccatcgttctcatcatcgaagccgtgggcgggaccagcagcaacagctccgtcaacgaatccgaagacggtggtgacgaagaagaagcgccgaagcgcggtcgcggccgcccggcgggcagcaccaagaaggcaccggccgagaaggccgctccgaagggcaagggcaagtcgaagcccgacccgctggacgacgaagacgaagaagaaggtgacggcgacgaggacgaaggcgacgacgacctcggcctggaagacgacgaagaagaagtgacccaggaagagctggtcgcctccttcaaggcgctgaagtccagccacggcgtcgacgcctgcaagaaggtgctggccctgctcgacgagagcaacgtcctgaacattccggccaagaagtacccggaagcgatgaaggaaatcaagcgcgcggccagccgcaagaagtaattcggcctgcacgtaacacggacgcccggcgatgccgggcgttctttcgagaggacacgatgaagccacgtcgcaacaaactcgcaaaggccgtcaaggaagcagtgcgtgcgcatgcgcgctttgcgccgtcgtctgcacagcgcatcttcgactgcccggccagcttggtgctcaacgagcaggagccggacagcgagaactacgaggcggccgaaggcaccgttgcgcatcacatcggcgagacctgcctgttgaccggcaaagacccggaagagtttctaggaatggtgttcgatagcggcaaccttgatgccgactacgacgaagagcttcattcctcgaaaggcttcgctatcactgttgacgacgagatggttgctggcgtcggtcagtatctcgattacgtgatgcgtctgccggggtgccacttcgttgagcagcgagtgaacatctcgcggtggtgcccgatccccgatcagttcggcacgtgcgaccacgcagcggccatgtacaagaagctggtcgtcaccgacttcaagtacggccgtatcttcgtcgagccggagaacaacttccagctcatcatgtacgcgctcggcttcatcaacgagtgggactggctgtacgacttcgacgaagtggtcatccgcattgcgcagccgcgcgtcgagaacttcagcacgtgggtcacgagcaaggccgagctgctggctatcggcgagaagatcaagaagcgcttcgccctggcgctcagcaagaacccgccgttcggcccgagcgagaaggcgtgccggttctgcaaggtgcagtacaagtgccgcgccaaccacgacttcctctaccaccagcgcgtcatgctgctggacgatgacggggacttcgttgaagacgacctcacgatgatgagcctcgaagagctgtcggcggtgtggctgcgtaagagcatgtacgacaagcgcatgggcgctatcgccgactacctgcacaccaagatcgccaacgacgagtttgtgcccggcctgaaggtggttgcaggcaagaagtcgcgctacttcaccagcgaactcgatgctgaaatgctcatggtcgatgctggcatcaagcccgaaaagctgtactctaagcccgagtttatttcgccccacgccgcagagaagttgctgcgcggcgaggcgaagaagaaattgcaggacttcatcgcatcgaagcccggcaaaccgtgtctggtctccgcagacgacaagcggcaagacctgaccgtgcagaagttgtcgctccttgatgactgacgcacgtagtagttcgacaatcccgacaaccgacaatctcgacagacgatagtctcgacaacgataggagcaacaccgtggctaagaagcaaatcccgcagaacgacctcgtggacaagggcgatggtcgctaccttctgaaaggcgctcgcctttcgttcgcctacctgcacaaccccgatgagcaggaaaacgatgaaggcaagaaaaccaagtcctaccgcaccgcgttgctgatcccgaaggcgaccggcgcacgcaccaagaagaagttggacaaggtgatcgccgacctcatcgccgaagagtacgacggcggcaaggtgggcagcgacaagcgcttcctgcacgacggcgacgacggtgacatcgcagagcacgagggccattgggtcgtcaacgttcgcgagagccgccgcccgacgctggtcgaccgcgaccgtcagccggtgatggaagaagatgaaatgatctattccggcgcgtgggtcaacgctgtgattcgcccctgggcgcagaacggcaagtcgatgaagaagaagaacaagtacggcaagcgcatcaactgcggcttcgacatcatccagcacgtgatgcacgatgatccgctcggcggcgcaatgcgtcccgacgtggacgacgtgctcgacgagctggacgacgatttcgacgacgtggatgtcgacgaggacgaagaggacgaacgccccgcgcgccgttcctccaagaagccgtcgaagtcgagccgtcgttctcgtgacgaggacgaagaggatgaagaggaagaagaggaagagcgtccgcgccgttcctcgtcgaagaagccgtcgaactcccgccgccgttcgcgcgacgaggacgaagacgatgacgacgacatcggcctgtaattcctcgggttgacagtgctacttcggtcgcccggggcttgtccccgggcttccgtttttctgagaccagcgcatgcaaaagcctcaatacgactcgacgctgcaccacgacttcgagaccttcagcgaatgcgacctgaaaaagcacggtctcaaacgctacgccacgcacaggtcgaccgaagtgctgttcctgtggtacgcgttcgacgacgaagagccgcaggtatggttcccgaagacgcagatgatgccgaagcgcctgcgccttgcgttgaagaacccacgtgtcaagaaggccgcgcacaacgcgcagttcgagcgcgccatctggctgcacgtgctggacatcgatattcccgtcgagcagttcgagtgctcgatggcacacgcattctcgctggcgctgcccggcgacctcgatacgctctccaccgtgctgcgcctggacgacaagacggcgaagatgaaggagggcaaggcgctggtgaagttcttctgccagccacgtaagccgaccaagaccaagcagtacacccgcaacaccaagctcaccgatccggtgaagtggcagaagttcctcgactatggccgccgcgacgtgatcgccgagcgcgctgctgcacgcaagatggcccgcttcccgatgagcgcgttcgagcagcgcttgtggactatcgaccagcacatcaacgagcgtggcgtgccgttcgacaaggcatacgtcgaagcggcgctgcgcgtcatctcgaaggagaaggcgcgcctcacgaagatcatgaagcgcatcacgggcctcgaaaacccgactagcggcacgcagctcctaccctggctgcgcgagcgcggctatccgttcaccaatctcaaatccgcctcgatccgcaaggctcgcgaggattgggattggaacatgaccgacgaagcgaacgaagtgctcgcgctgcactccgaggccgcgcgttcgtctgtcaccaagttgcagaagatgctcgacatcgaagtcgacggcatgctgtgctacacgatgcagttcgcaggcgcaggccgcactgcacgctgggctggccgcgcggtgcaggtgcaaaatttgccccgccccctccgagagatggaagagcagtggcagctccttcttttgcgagaagcgatcatggccgaggacatggattgggtccgcatcctcgtgtcgtcgccgatgggcgcaatcgcgtcgtgcatccgcaccgcgatcaaggcaccgaagggcaagatgttcgtcacctgcgatctgtcgtctatcgagtcggtcacgattggctggctggcggattgtcagaagatgatcgaggtgtttcagaagaacctcgaaatctacaaggtgttcgcctcgcgcatgttcggcgtcccctacgagaaggttgagaagtggatgcggcagcaggcgaagcccggcgtgctcggcgcaggtttccgtctctccggcggcggcgaagtgggcgagtacccggaagtcatcaagaccggcctgctgggctacgcagagagcatgggcattgagatgacggcggaggaagcggctgcggtggtagcgttcttccgcagcgagtacgacgaaatcgtgcagctctggtacgacctcgaacgtgctgtcgagaaggtgatgcgcacgaaggagccgcagcgcgtcggcccgattctcatggacgtgaaggggccgttcctgcgcatgcgcctgccgtccggccgctacctgcactacctgcgtccgcagatgtcgtggaaaaagatcaaggtcggcatcgacaagaggaccggcaagccgaagtacaagtcgaagaagggcttcagctacgagggctacggcgggaagagccgcaaggtctggatgcggatcgactcgcacggcggcaagatcgttgagaacttggtgcaggcgattgcacgcgagctgctggctatcggcatcgtgaccgcttgggacaacgggctggacatccgcatgcacgtacacgatgaaatcgtaggcttggtcaaggcgaagctcgcagagattgcagcgcgcgaccttgaagacgacatgaccgtacagccggagtggtggggcgacgaagtgccgatccgcgcgaaggcagaaaccgtggagtgctatcagaaatgagaggcgacatcctatcaaccgacaagcaccgtctcgaaaaagacgtagaagagaagtggtgcaaggtggcgcgcaaggccgggtggaaggcgtacaagttctcttcgcccggcaacagcagcgttcccgaccgcatgttcgtccgcaacggcttcgtgttcttcatcgagttcaagcgccccggcggaaagcctacggcgaaccagatcgaagaacacaaggagctgcgaaagaagggcatggtcgtgctggtgatcgactacttcgacaaagagttcgccgagtgggtgttcgcatgaaggaacgactcgaacgctcgctactggacgactatcaacgcgctgctggcctctttatcgagagtgtcggcagttgtgctttgtgggtcgacatgggcctgggcaagacggtggtcgtgctcacgcacgtgtccgacaaggtgttctccggcgagtggagccgcgtgctggtcgtcgggccgccgctggtggtgtccgacacgtggcctacggaggtcgatagctgggagcacacgcactggctcgactttcaggaactcgacggcacgcctgagcacatgcgcatgcagttggagcggccgtgcgagattgacggcatctcggtgcataagctggatcgtctcgcgtcgctgttcaagaacaacaagaagccggtgccgtgggacgcgattgtgttcgacgaatcgagcatgttccgcaataaggcgtcgaagcgctggaagcacgcggtaaagctcgcgcaccgccccgagactgacgtgatccagctcaccggcacgcctagtccgaacggcctgcatcaagtgtgggcgcagatggcgatcatggacggcggcgagcgtttgttcgcgtcctacagcaagttcctcgcgcacttcttcaacaaggagttcatggggcgcaagatcacgccgaagccgttcgcgctgaagtcgatcaccaagcgcgtcgccgacatcgtgtacacgctgcgggaagaggattacgtcaagctgccgccgctcattcctcgcccggtgccgatcatcctgcctaagaaggtcttggagcagtatcgggagttcgagcgcacgtcggtgctgaagtggggagaggaagaagacccgaacgtccgcgcgctctcggaaggcgcgttgtacggcaagctgcttcagttcgcatgcggccgggtctacaccggagatgatgagaagaccttcatcgacgtgcatgaccgcaagatcgagcgcatgaaggaaatcgtcgagtttagcgacggctcgccgattctcgtggcgcgcacgtggcagcactcgcggctccggctgaaagacgcgttcccgaacatccgctcgctgaagacgaagaaagacatcgacgcctggaatgcgcgtgacatcgaaatcgcagaagtgcatccggcgagcatcggtcacggcgtcaaccttcagcgcggcggcaacaacctgatctggtacgaccacacgccggatttggagctgtacatgcagttgcgaaagcgcctgcaccgccgaggccagcaagcctcacacgtgaacatgatgcacctgaccgcgataggcacgattgaagaagacctgacccgcgagctggtgcgcaaagaagtaacgcaagacgccctgaaagaacccatgcggcgacgtgtcgccgacgtacagagagaactgaaaaatgtccgcagctaaaatcgactacgaagaagagttcttcaacggcatgacgatcccgcgcctcgcgcagttgttccgcctggaccgccgcaccgtcaccgagaagttgcgcccgctgcgtccgaccggcgaccgccgtggcgcgcccacctaccacgtgtcggccgccgcgccgtacctcgtggagcctatcgtcgacatcgccaagtaccttgcggaagtcggccctggcgatttgccgtccgcgttgcaggcgcagtattggaacgcgcagaacagcaagttgaagtacaaggagaacgccggtgacctgtggcgcacgcagcaggtcatggagattttcgtcggcgctttccgctcgctgtcgcagacgttgcgcctgctggcggatcgcgttgaggcacgcaccgacctgacgccggaacagcgcaagatcatcgagcgcgaaatctccgatgtcgcgttgacgacgctgcgccagcgccttgtggaagacttcgagatgtacgcaggcttcaaggacaaggagcagctcgccgacatcaaggtcgacgacatcggactggacgaggatgagtgatatggatgacctgttttcgtctgcacagctttcccagggcgcgcagagcaccttcaacgacctgggcgaactgctgacctacgctgcgaactcggtgctgctcccgcccgagcgtttgaccgtatcgcaggcagcgtcgaagtaccgctacctcgacaacgaaggatcgtacgtcggcccctggctcaatgaagagacgccgtaccttgtcgagccgatggacgtgctcaacagccgcgattttgagtcgtgcatcttcatcggccctgcgcagggcggcaagaccgaaatcatcttgaactggatcgcgtacacggcgcgctgcgacccggccgacttcttcttgatccagaccgcgcgcgacacggcgcgagatttctcgtaccgccgtatcgacaagatgcaccgcgacagccgcgagattggcgcactgctgcgtcccggcaatgacaacgacaacatcttcgacaagttctaccgcaacggcatgatgctcacgctgggctggccgacgatcaaccagctctcgggcaagccggtgccgcgtgttgcgctcaccgactacgaccgcatgccgcaggacatcgagaagaacggcccgccgttcccgctggcccgtaagcgcaccacgacgttcggctcgttcggcatgacgctggccgagtcgtcgccgtcgttcgacgtgaaagacccgaagtggaagccgccgcgcccggactcgcacatgttcccgccgactgacggcattggcggcctgtacaacgaaggcgaccgccgctgcttctactggcagtgcccgcactgcggcgagtggttcgagccgaagttctcgctgctgcgctgggacacgaagaaccccgatccgtttgcggcttccgagtcgaccgtcatggcgtgcccgaagaacggctgcgtgatcgagccgaagcacaagtacgagatgaaccgacgcggcgtgtggcttcgcgatgggcagagtctcgaccgcgacggcaacaagcagggcgtcggcgcgcgttcgcgcactgcgtcgttctggctgaagggaccggccgcgcgcttcatcacgtggcagaagctcgtcgagcgtatgttgcaggcccagcagacgttcgagctgaccgctgaaacgaaggcgctgaaggccacgatcaacaccgaccagggcgaaccgttctggccgttcaacgctaccgactcgaaccgcctgccggaagacctgcaatcgaacgcgatcaagtgggccgagaagaaggtgccgtacggcgctcgcttcctgctcgccaccgtcgacgttcagaagaacatgttcgtcgtgaccgtacacggcatcggcccgagcgagagcggcgcgggctacgacgtgtacatggtggaccgcttcaacatccagaagtcgaagcgcaaggacgacgcaggcgatacgttgtgggtcaagccgtacgcggtgcaggaagattgggacttgattacagagcaggtcgtcgagaaggagtacgagctggaagacggcagcggcttcatgtcgatcaagatgacaggcatcgactccggcggtaagtcaggctccacgacgcgcgcctacaactactggcggtcaatgcgtgatagcgccaagggcaaccgagtgctgctcatcaagggcgagccgaagttcggtgccccgcgcgccgagattgactaccccgactcggatcgaaaggatcgctcggccggtgcgcgcggcgaggtgccggtgctgttcttgaactcgaacgtgctgaaggacacgttgctcggcatgctcgacgcgaagaaggacggcggtgctcgctacttcttcaacaagtggacgccggactatgtgtacgtcgagatgacggtggagttccgcgacgacaagaaccgttggttgaacccaggcaagcgacgcaacgaagcatgggatttggcgtactactgcctcggcctctgcaccattctgaaggtcgagcatttcgattgggacaacccggagagctggtacgacgagtggagtaacaactctcttgtgcgacctgccgatcaggaaaagaggtttgcgtcaagcccgactacggattatggtttcggtcaattcggagccaccctgggatgacgcacaatgaccctcgaacagttgcaagccatgcttgcggaggcacaagcggcctatcacaccgccatgatgggcggcgcggtgacggtcgtggtcgaccagaacggggagcgggttgagtacagccgggccaacccggcatccctgctgaagtacatcgccatgctccaggctcagatcaacgccatgctgggggtcgcagtaatcggcggcccccttcgccctctcttttaaggcggcctagaccatgagccaagacctcgcagtagtacgttctccggagggcgatgccgccttccagcgcacgatgaacgacatgattttcggcggtgccttcgagggcgcgaagaacctcaaccgacagaccgcgttgtggtccgcgccctcgctgccgccggacatggaaatcacgccggacaaagtgcgcatggatgcgcgcacccgcgatctgattcgcaacgacggctacatccagggcgcgctcgacacgagcaaggactccatcgtcggcggccagtaccttttgaacgctcggcccgactggcgctcgctcggcttcgacgaaaagtgggccgaagagttccagctcatcgccgagcgcaagttcatgctgtacgccgagtcgccgatgaactggattgacgcctcgcgcaagaacggcctgacgggtctcgtgcgcatggcgctggcccaggcgttcatggcgggcgagacgctggcgacttcggagtacctgaagggcaacggccgtccgtacaagaccgccatcaacatgatcgacccggatcgcctgtcgaatccgaacgacaatagcgacactgcgttcctgcgccgtggcgtggagattgatcgtttcggtgcagcccaggcgtaccacatccgcgacgctcacccgatggaatcctactacgaccgattcggcgcgaagtggacgcgcgttccggcgttcaagccgtggggccgcccgcaggtcatccacatcgccgacatcctgcgccccggtcagacgcgtggtgtttcgcagatggtggcggtgctgaaagaaatgcgcatgacgaaggtctacaaggacatcgttctgcaaaacgcggtggtcaatgcgacctttgctgcggctatcgagtcggagctgccgcgcgagatggtgttcgcgcagctcggctccggcgacatgacgtggttgcagaagtacatgggcgcgctggccgagtacgtgggttcttccgacaacctcgctatcgacggcgtgcgtatcccgcatttgttcccgggcacgaagctcaacctgcaaaacgccggtcagccgggcggcgtcggcagtgacttcgaggactcgctgctgcggcacatctgcgcggcgctgggcctgagctacgagcagttctcgaaggactactcgaagacgaactactcgtcggctcgtgcgtctatgatcgagacgtggaagttcatgcagtcgcgcaagaagctcatcaccgaccgcttcgcgacgatgatctacatgctgtggctggaagaggaaatcaaccgcccggagaccgatctgccgatgccgaagggtgccgcgcatttctacgagggcatcaatcgcgaggcgtacatcaagtgcgactggatcggcgcatcgcgcggccagatcgacgagctgaaggaaacccaggccgccgtgctgcgcatcgcatcgggcctgtcgacgtacgaagacgagctgggcaagctgggcaaggactatcgcgaagtgttcgagcagcacatgcgcgagcagcgcctcatcgagcagaagaagctcaacttcacgatgtcgaccagcaagccgggcacgcagaaggctactgacagcgccgcgaacgatgacgccaaggcggacacggctaccgaaaccgaaacggagaacgacgatgaatgaattgctggcgatgcgcatgtcgatcatggagggcttcaacggccgcccggccctgatcgcaccgcaggagatggagaatatcgcgacgatgttctcgtcgatgatgcttcagcaggccccgccgaccgccgaacagcgcgcggcggctgaagaggcccaggtggtgctcatggagcgtgccttcgacatctcgttcccgcgcgagcgttccaaggcgtttgccttcagcgacggcctcgccttcatcccgatgcgcggcacgctcgtgcatcgtaacggcgactcgtggtacggcacgcgcggctacgacgacattcgtcgcgagttcgacgctgcgatggccgacccggacgtggcgggcatcgtattcgacatccattccggcggcggcatggtctacggcaacttcgagctggccgatcacatccgcagcaagcgcgccgagaagcccaccctgtcggtcgtcaacgcgggcgcgatgtctggcgcgtattcgctgggcagctcggcgaagaagatggtgtcgaccccctccggcgattccggcagcatcggcgtcgtcaccatgcacgtcgatctgagcaaggcgatggagaagttcggcgtcgccatttcgctgatccactccggcgaacacaaggtcgacggaaacccctatagtccgcttcccgacaacgtgcgcgccgacatgcaggtgcgcctggacgggatgtggcagaagttcatttccgtggttgcagctaatcgcggaatgtccgaacaagcgattcgtgacacgcaggcccgcgtctatggcgcggacgatgcggtcaaggtcggcttggtcgatgcggtcatgtctccgcaagaggcagtcgcttccttccgggccgaagtcttcggctcttccaccagcgaaaacaggagtcccaccatgagcgataccaagaagcccgacgccaccgtcgaagagcagaagaagaccgacgccaccgtcgagcagcagaagaagaccgaagagaaggtcgaccacgctgccaacgagcgcgctcgtatcgaaggcatcaccacctgcgaagaagcgaagggccgcgaaggtctcgccaaccacttcgccttcaagagcagcatgagcgtcgacgaagccaaggccgcactcgctgcgtcgccgaaggcgtcggcctccaccggcaagtccgcgctcgacgcggcgatggaaaagaccggcggcggcgctgacatctccaataacggcggcgacggcgaagacgaaggcgacaagggcgagaaggccgatggcggtctgctcggtgcctacgcccacgccaccggcaacaagagcgtgctgaaggccgtcaagtaaagaacaccgtcgccagcctagacgggaaaaaccggctacctagtccactcacaggagtacatcgcaatgaccaactttggccccatcgctggcgtctcggtcgacaacagcaacgccaatggcaacatccagctcttcgctggtgagtccgacatcgttaccacccaggtgcagctcgtgaccggcgtcgcctacgtcggcggtcaggtgctcggccgcgtcaccgcctccggcctgttcgccaagcacgatccggcggcgaccgatggttcgcagaacgcaacccacatcctcggctacgacgttccgacgccgaccgctggcaagtgggaaggtgcgtactcgggcggcgtgttcaacgtcgatgccctgaccttcaacgctgcctccaacaccgtgcagaagaagatcgcggtcttcgacggcacgaacatcgtggcgcagcgcctgtacggcaaccccgccccgaactccggcccggtctaaccggcgattcacccgcaatacgtttcgcacataactcaactgaaacaggagaagcacgatggatttgtatagcactgcggaactgcgcaaggtgatcgtcgacagccggccgcccgtgcagtatttcctcgaccgtctgtacaaggagcagatcaacttcacgaccgaagaaatcatgttcgacgagctgcgtctcggccgtcgcatggctccgttcgtggctccgaacttgcagggtcgcgtcctgaagcgttccggcttctacaccaagaccttccgtccggcctacgtcaagccgaaggatgcggtcaccccgggccgcatgctgcgtcgcttggccggtgaaggtctgaccggcgacatgaccccgggccagcgctggcaggccactgtggccgcgtaccagctcgatcagcgcaaccagatttaccgccgcttcgagtggatgggcgcgcaggccgcgctgtacggtcaggtcaccgtgtcgggcgaagactacccgagcgtgaccatcgacttcggtcgtgccgccaaccacaccgtcatcctgtcgggcaccgccgcgtggagcgactacgacaacagcaacccggacgacgacctggaagattgggccgcgcgtatccgtgaagctgaaggcttcgtggtcactcgcgtcacgatgggcagcaccgcctggaaggcgttccgcaagcacccggccatcaaggagctgctggaaacccgtcgcggctcgaagtcggaagccgagaccggcccgggcctgggcgagagcgtggagtacaagggccagatcggcgcgttcaacatctacgtgtacagcgatgtgtacgaagacgagaccggcaccatgcagccgatgatggacccgcgcgacgtgctgctggaagctgaaggtggcttcgacggcgtgcgtgccttcggcgcgatcatggatgccgacgccggtttgcaggcgctcgacatcttcccgaagatgtggaagaacccggacccgtccgtgatctacctgctgtcgcagtccgcgccgctcatgatcccgagccgtccgaactgcaccctgcgcgcacgcgtcgtcgcgtaaggccgtttcaccagcaacgcccggttcgccgggccgcgctgtttacaccacccaatcaaccccgcaacaggagatgtagaaatggctgacgacaagaagaccaccaaggctgcggccgctggcaagaagctggtcgctcgcgtggcgctgaagggcgacttcgatgccctggatggcctgggcaccgcgatgcaggaaatccaggcgggccaggagttcaccaccgaagacgccaagttgcagaagcagctcgtcgacaacggctacgccaagtcggcgaaggacgcggcgaaggaagaagacgaggctccggccagctctggctccgccccgccgaaggtcgagacgaccgacaagaacgacggcaagaagcagcagtaatcgcgcctgggcgctaggagacggaacatgggctggcttgaaatcaaacaacgcgcgcgtgatgtgacgcacaagacgttcggtatcccagccctgttccgttcggcgggcggcgtgtctacggacacgtccgctcgtttgcactacaaggtgcgcacgtacggcgacctcgaccgcgaaggcttcgcgacgaccgtcgacgatgtggactacgttgtgatcgacactcgcgagctgctggcaaacggcatcgtcgcagaagagggcaaccggattaatttcccgcagctcaacaggactttcaaactcgacgtggagcatccttccgaggacagtcgctacgtcaagtgggcagtaacggagaccgctccatgaccatcggcctgaccatcaacggactcgacgacgtgcgcaagatggtgagcggcataccggaaacggtcgaccgcgcatcggctgttgcgatcaacgaagcgatcacgttcggtcaggccgagagcagccgtcgcattcgcgagcaggttgcgttcaaggcgagctacatcggcaacgcgaccgatccgggcgcgagactgcgtgtagcgaagaaggcccgcgtaggcgacctcgtaggcgtcatctccggtcgtcaccggccgacctctctggctcagttcgagcagggcgcgaagctcggcaaaggcggctacgttcgagtcaaggtttccgcgaccggcggatcgaagcgcatccccggcgcatttccgatcaagctgcggcgcggcaacggcgtgtacgacgccgagaactcgaacgaaggtattgcggtgcggctcaacaagcagggagagctgcccggcggcttgaacaagaagcaggcggtcaacgtgagcggaagcctctacctgttgtatggtccgtccgtcgatcaagtatttcgtgatgttcggttcgatgtgcaaggcccggtgggtgacgcactcgaatcgagcttcctccgcaacttcgggagattgaaccgtggctgatacgaagcgactgttgctggtcaagacgctctgcgattacctgaagagcgaaatcaccctggcgaacggctacaacttcgacctcgcgatggttcgtcgtgacaagcgcaacttcggcaaggagatgaagctgccgggcgtggcggtgctggaaaacttcaaccccgaccgcttgccggaaactatcggcgggttcgtcgggcagaagcacaagtacgatcagatttacctgctcaacggctgggctgacaactcaggactggccgagggcgacgatgagacggatgcggcacatctgctcatgggcgacgtaaaaaaggcgctggggaagttgattaccccgcgcaaccaagacgggttcttcggtggtctcgcaaacacgctgtccatcgaacccggggttgttcggcctcccgacgagcaatccgacaaagcgtacttctggatgagggtccgaatggaactcgtcgagaaggtgggagacccgtactggattcgtgattaacccctgcaacaccacccgaaggagaccacaatgggcagcgagaattacacccttggccgtggcgaactgcgtttcgacaagttcgtaccgggcacccgcaacaagaccggcgagcgttacctgggcaacaccccggaactgaacctcaccaccgagagcgaaaacctcgatcacttcaacagtgaccggggcattcgcacgaaggacaagagcatcgttctggaaaagaccgacagcggcaccttcatcgccgacgaaatcagcgatgacaacgtggccctgtggttcctgggcgacgtgagcgtcgtggcgcaggcggccctcaccgcgcaggtccaggtggttccggccaaccgcgtcaagccgggcacctacatccagatcggcgagtcgctggcgaacccgaccggcgtgcgcaacgtgaccatcaccagcgtcaccgatggcgcgggcacccccgtcccgtacacgctcaacgaggactacaccgtcgactccgagctgggccagctctacgtggtcccgggcggcgctatcgacggcaccgaggcgttcaccatcaactacagcgcggccgcctcgacccgctcgcaggtcgtggtcggcgacggcaccaccgtggaaggcgcgctgcgcttcgtctcctacaacccgaccggcccgcgccgcgactacctgtggccctacgtgcagctccgcgcggacggcgatctggccctgaagggcgacgaatggcagcagctcagcttcgcgttcgacatcctgaagctggacggctacgctaccgtctacatcgacggccgtccccaggtggcgtaaccggggcgcgtcaaacgcggtcaaggccaacttagtcaagaccaagaaggccaagaccaacttcgacaggccgctctccgaaagggggcggcctgttttcttgccagcaaccgaggaagccaatgtccctttcgtcccttcgccttcgcaccatcaccgtcccgtacctgggcgcggatgacgagcagcagagcatcgtgctgttcggcctcaacgccaacgacgtggccggaatcatcatcgcgcagaaagacaacatggaagaaatcttcgacatcgttgaaggtgccggtgtcaagaaagccaccgacctcgctgaagtcgacatgatgcagatcggccagaagctcatggtgcagatgccggacttcatcgcacgcgttatcgcgtacgccgcgcacgagccggaagcgtggatggtcgccatgcagctcgacgcgccgacgcagatcaagtgcatgcgcgccatcgccgaacttaccttcaaggacgaggccggattccgcgagttcctgggaaacgtccaagcggcacttcgcggagcaaaaagcgtggtgccgcacctgcgaaacaaaaatctcgaatcgagcgattcgcagggtggtggctcggaatccgagcagcagtctccttcctgaccgctgaaggacacgctctcgcaggcgagtatccgctgggtgtgttgatcgtagaaacggaactcgcgcgcgagcgtgtcaacaaccgcattagaactgaagcggttttgattcaaagcgcaatcggctccgcgctcagcaagaagggcgcgcaggcattcaaggaacaaatctcggagctataggcgatggccgctcagaacgaagttgaactgatcgtacgtgcgaagaacctcagtacgaaaaccatttctcagctcaatgacgagctgggcaaagtcgccgaaaaccaaaacgaagtagccgatgcgaaccgtctcgccgagcggtcgttcgagagtctgaagggcgagcagcagaagttgctcgctatcatgaagtcgctcaacgaccgctcgcgcaagctggaaggctacgctcagcaagagcagcaggtgcgcagcctccgcgaagaactcgcgcgtgctcgcgaaaacctcaacacgctcgcgcagcagtattacaacaccgagaagccgacgaaggagttcacccagcagttgaaggccgctggcagtgaagtcactcgcctggacgcgtcgctgcggaataacgagcgccgcctggaaacgtcgggcgcgaagctgaaggagatgggcgtcgacacgacccgcttcagccagtcgcagcaggaactcaacagtgcggtcaacaactcgctggcgctgtaccggcagtcgaccgacaacatggagcgctacgacaccgctgtccgcgaagtgcggcagcagcaggaactcgcgcagcaggaagaacggcagcaggcgcaggccgcccgcgattcggccgctgctgttgcccaggccgcgaaggaccgcgaagagcaggcccggaaggagcagcgcttcgtcgagctgaccaccaacgtctaccgcaccctggcccgcgagaaggagaaggcggcggccgccggggcgaacttccgcgccaccggcacgcaggctgcgcaggcggcccgcgctaccgccgcccctgccgtgggtagcgggtcgaccctgggcggggcagcagcgggcgtacaggcggtgctggaaccggccaagcaggcggtcgctacgctcgaccagctcgaaaaggccgtcgaccagctcgacaaggagttcgaggccctgacgccggacgccctgaaggccgctgacggcatcgagaagctggccgaccagagccgccgcctgcgggaagcggccgccgcgctgaagggccaaggcggtctcgccgatgacctcgcgcggcagaacacggccttgaccgccagccagcagcggttcgaggaagcgcgccaggaagtgctgcgctacgccgaagccgtggagcgatcggatcgcccgaacgacgagctggcggcgtcgctgcaacgcgcacaggccgcactgcggcaggcccaggcagacctgggtcgacagaccgaagcgttcaaccgcgtgcagcagcgtgcggcggccgcaggcatcaccctggaaaacctcaacggcatcgagcagcgcctcgctcagaacgccactcgcgttgcgaacggccagaagcaggtcgcgcagacgatgacgcagttggagcagtcgaccgcgaagaccagcaagcagctcaacgcgctcaacaccgggcagcgcaccgcgctgtcgctgtatcagcgtacccgtggtcaggtgctctcgctggtgtctgcctacgtgggcgtgttcggcgcgatcaatctggtgaaccaaagcgtcgacgccgccgtggatcgcgagcgcgcaatgtcgcgtctcatgatcgcaaacaagggcgacgccaacgcggcggcgaaggaatacgactatctgcgcaagaaggctgacgagctgggcctcgccttcggcccgttggcggattcgtacagccggttctcggttgctgcgcgcgatgccggtatgtcggcggaagcaacgcgttatatcttcgagtcgttcacggaagcggcgacggtcctgcgcctgagtggcgaagagactgagggcgcgttccgcgccttggagcagattttctcgaagggctacatccaggcagaagagcttcgcggccagctcggcgaccgcatgaccggcgcgttcaatttgttcgcgaaggctatcggcgtgtcgacgcaagagctgaataagatgctcgaaaagggcggcgaggttaaggcggagttcgtgctgctggcggcgcaaactgcgcgcggtatttatggtccgcaggccaaggccgcatcgaacagcttgctcggcgacattaaccgcatgtcgaacgcgtggggcgatctgaagcgtgaaatcatcgacggcggcctcggtactgcgctgcgcagcctgttcgtcgatctgacgaagttcctgaagagcgacgacggtaagaagttcgctgcgaatctgacgaaggtcttcgtcgcggccgctgaagcgggcaaggagctgatcgacgtattcgccgagtacgacggcctgatcgagaccgtagcgaacaccgtcgccttcctcgtgcggaacttcaaggagctgatcgcgatcatgctggcgatccaggcagcgcgcatcgccatcgtcttcactcagctcgctacggaaatcctgaaggcccgtgcagccacggtcgcgctcaacacggcgctcggtgcgggcacggccgcgtctgccggtcgcgcaggcgcttcgctgctggcgctgatcggcggccccatcgcggcgctgctggcaatcgcttcggcgggcgtcatcatcccgatctatttccagatgaagggcgagctgaagtcgaacaacgacaagctcgatgtgcagaagaccgtcacggaactcaaccgtggttttgcggcgtccgagcgaaacctcgcagttctgtcgcgcgacaacaccgagcagttggaaaagcgcgtgcaggcagcgcagcgcttgctcacgatctacgatgagcagaagaagaacctcgccgatcagatcgcgcagaacacgaccatccgcaagaatcaggtcgcgattcgcactgcgcagagcactcgggaaggcgacgccaatctgccgtcgaagcagttcgaggctatccggcaggtcgaggccgagggcaaggcgatggaggcgcagctcgccaacctcgaacgccgtgcggccccgctgcgcgagctggtcgcatcggccagccgtgacctcggcatcgcgaagtcgaaggcggccgcgaccgagaacgatgcgctgtcggccgagttcaagcgcatccaggccgaggcggacgcagcggcaaagcgtgcgggcacggacaccaaggcagcgaaggcggccgaagcggcgcgcaagaagaaggaggccgaagagaagcgcctcgccgccctggccgagcgccgtgtgcgcctggaagaagacgtggccgagaagctgcgcgacatcgacagcgacatcgcccaggcgcgcccggatacgctggaagaccggctgaaggtgatcgacaacaagatcgctgatcgcaaggcagagttggagcgcatgatccgcgaggcggaaaagctaaacgtgcccgatgcgaagaaggaagcgcagcgcggcctggacgcactgccggacctcgaaaagcagcagaagcagttggccgagcaggagttctacgaggctcgcatcaacaccctgttgcagcagcgcagcacgtccatcgacacgatcaacaccttgcaggaagccggtctgctgacggcaagcgaagcgtccgcgcagatggaagaggtcaacgctcgtctgctgccgcagctcgaagctctgcgactgaaggcggtcgagttcatggctacgctgggcgatggcccacaggcccaggctgctcgcgcgaacctcgaaaacctcaatgcgcagatcaaggcgatgtcggtcgagatgtcggcgactaagcggaagatcgtcgacgtgttcaccaacggcttcacgaacgccttcatggagagcgcggcggtgatgtccgactacctgaagggcatccagagtgcgggcgacgcatggaagagcttcggcgacatcgtgctcaacaccatcgccgacattctcgtgcagctcgcgcagatgattatccagcaggccatcttcaacgcgctgaagcaggcttcggagagcgcgagcggcggctggggcgcgatcatcaacgcggcgatgagctacgtgaagcatgacggcggtgtggtcggcgcggcgtcgaagaagcgtgcggtgccgagctacgtctacgagagcgcggtgcgctaccacacgggcggcgtggcgggcttcgcggccgacgaagtaccggcggtgctgaagaagaacgaagaggtcttgaccgaaaacgatccgcgccaccgcttcaacggcggcatggctggcggcagcggcccggccccggtagacctgtctatcatcaacaccatcgacagcgagagcgtggttgcggccggtgctaacacccgcgctggtcgtcaggcgatcttcaacgtcatcaaggctgaccgagcctccttcaagaaactcctgggcaattaaaggaaccaacatgggacacgcaatcggaactgttacgggcggcagcggcgacgaggcgtactacaaggtactcgctgcgatcaagaccctggctgaagcgaacggatggacgacgctgcgctacgtcaacacaggcacgaaccgcgagctgattttgaactcgaagggcttgtcgggaacggaggacatctacatcggcttccgtacctacttcagcacgagcggcgactactacaatatcctcgtgggcgtgttcaccggcttcgtatcggctaacacgttcgacgctcagccgggcgcgcggctttctggcgtgccgtgccataacaacgccgtcacctacttcatcactgccaacgcccagcgcatcgccggttgcttcaaagtcggcacgccggtctacacgcacttctatgcaggcaagatgttcccgtattcccgccccggcgagttcccctcgccgctggtgtgcgcgggcatgttcgacggcgcagcggcgaagcgattctcggacctcgactacgcgttcccgtatcacggtcgtgagagcggcgcgtcttccccggagcgtccttcgctgctgtggctgcgcgatcaggtaggcacgtggcgtcgcctctcgcatttcccgttctataacggcgcggctggctcgaactcgtggaacggctacaacgcgttggcgaactacagctacttggacacggacgtaagccaccgctccctggtcccggcaggaacgaactaccagccgcagccgatcatcctgtacaccaccacggccagcggcgacacctacgcgggaaatgtcttcggcgagctggacggcgtgtaccagatttccggcttcaacaacaacgtggagaacgtggtgcaggtcggcggcactgcggtggacagcaccggcatgaccgtggctgagcacgtcgatgcagtccttgcggcgggcggccgcgcattcgtgatgctgcaagacgtgggtcgaaccgactggcgcagcttcatcggcttggagatgacctaatgttctacaccggcaatttttcttcgttcgtgacgctgaaggcgtcgatggaagcggcgcttcagaaccacggctgggcgctcaacggcgacggcacgctggaaaagaacggcatgtacgtccgcctcgtggcgaccgacatctaccagatcgcagcgttcgcaggcaccggcagcgccgtcgacccgttccctctgccgggcgcggctccgtacggcgtgaaaatcatgaacttcagcggctcgccgatgaacttcccggcgacctatgacctgcacgtgttcgaggaaaccgatgaggtctacctcgtcatcaattacaacggcgacaagtaccagcagttgtcgttcggcaagtctcgcgtcgatcaggtcggcggcaccggcatgtggctcaccggttcgttccgcagtgacgtggtgcaggcggcaacccatctcgtgtacaccaacgcgtcggatagctacgtcggcttcgggtggagcggcatggggtgtggcttgttccacgaggtatacaacgcgcccctgggctgctcctacatccacactggcctggactcaaccgggtggaagcgcgtagggaccagcgaaggtgatttgatgggcagcggcgatccagttgccgctctgctgcaatcgctgccgtcgcagttcaaccagagcaccgtgctcctgccgttgctcgcggtgcagcgtcgtctctcgaaggggcagactatcgccgcagacctgcaaaacgcgcgcctgtgtcgcaacgacaaccacctgtccggcgaaatcgtgacctacggcaccgaccgctggaaggtgtacccgttccaccgtaagaacgcagcagtgcgcaacggcgtgccgtggtcgaccggcgcggatcacagcggcacgtttgcctacgccattcgctacacggggccgtgacatggcagcacgtatcggacaaatggggagcgcgtttgagcggggcatcgacaacccgatgctcagtgatgacctcaacaaactgactgaagtcgtgtcgatgttcgacagctacgacggcggtcgcttcttgcagggccgctacggtagctggcacgtgcattcgagcaaccaccggggtgtgtcggcgcagcgcaagatgacgagcttcttcgacgactactacaaccgcatcttcatcgtcccggccgccctggatgcgggcaatctgctgtccacgcaggtccggcacatcatcctttggaatgcctacgtcacgccgcagacgttggagtcggccgtgctcggcccgcaggcaggcatttcgatgtctcccccggcgggcgtcagcattccgttcgagatgccgccgctgcgtgagctggatttcaccgttcagatcgaactggcaggcccgccgacgatcagcagctatgcgcgcttcaccgtggaaggcgtcaactacaccgtgccgatcaccggccgccgcatcgttctcttcccgttctctccgaattgggggtctccggtcgacgagacgatcacgcatcgctcgtgggtgctgtcgtcggacgacggtagcgagcagaccggtagcgagtcgggtgaagtgccgcgacgcacgttggagttcaacatcaatctgcggacttctaagcaggcccagcgcgccgagaatctgctgttcgcatggcaggcccgcttcttcggcgtcccgcattggggcgaagagtcgcgtaccgacgcagccgtcgaagcgggctcgctcgttatccccttcaacaccttcggcctgtcgctcgaacccggttcgctggtggcgctgtatctcgacgacgaggtgaacgaaatccgcgaagtgcagcaggtcactgctgacggcgtttcggtcacgaccgggttggagtacgactggcctgccgactcgcgcgtgtatccgtgtttcgttggcctcatgagcgaagagatgtccgagcagcgcgagacttcccgcgttggccgcatggcgatgtcgttcgacttcgagccgagcgtaacgccgggcaacgcggcgatgaacccggacccgatgacctaccgagggcacgagctgtacatcaaggagaccaactggctgtcggcgatgcctttctccttcagcgcggacacgaagcgcgtagacaccggcacaggcaagttcgttgccttcaccacctcgggcttctcgaaaatcagccgccgccataactggacgctgttcgaccgcgctgacattttcgagttccgtcgtttcctcggccgtcgccagggtgttgctcgttcggtctacatgccgagcggcaccgaagatttcacgatggcggcgacgatcctcgacaccgagaactcgctcgtggtggagtcgaacgaatacgcgaagctggtcggtgcgcatcctgctcgccgcgacatcttcatcctgttgaagaatggtcggtatttctgtcgtcgcattacgctggttagcgagttcgacaacctgacccggttgcagctcgacagtgcgctcggcgaagaggtgcggccgcaggatattcgtcggatcagttttttgacgctgtaccgcttccagtctccttccaccacggtgcgctacctgaccgattccaaggccaccgtcgagtcgatgctggtcgccaagatgaccgaggactgatatgtctctggcccaatacgaaagcagcaaagaacaaggctctcgcgtggagctttacctgtttgagagcgacgacggccgttaccgctgggcgtacaccaccgatgcgcgggagcgctcgattggcccgattacttacaggcccgaagcgattaaacgcggcgagctgaagcagaccgcaggcgatgccaacgtcgagagcctggaagtcgtcgtgccgttcgacaaccccgtggcggccgcgcacgtgccgtatctgccgcctcgccctatcaagctgacgatctacgcgtaccagcgcaatgaccccggcgcggaaatcgtgcaggcgttcaccggcttcgtgacgagcttcagccagaagggagctgacgcgacgctgcaatgctcgcagatcatcgacaacctttcgcagacggtgccgtgggtggtgttcaaggtcggttgcgtgtgggcgctgtaccagatcggttgcggcgtcgacaagtcgctgtggcggcgtgatgcgctcatcaccaccgtggacggctacacgctcggctcgcctgagttcgcgtccaagccgaccggctactacaccaacggcttcatcgtcgaccgcgagaccggcgagcagcgtttcatcacggcgcatgacgcagccaccgccacgatcaaggtcgtgtatccgttccaaacggtgcagggcgggcagattctcgacgtgtacgcaggctgcgcacgcacgaaggaagtctgctcgggcaagttcaataacaagatcaactacgtcgggttcgatcacttcccgacctacaacgtcttccagcaggggatcacctaatggcctggatcgcaattatcgtcgcaatcgtcgtcgcaatcgtcggcgagctgctgcggccgaagcagaagttcaacgacccgaacccatcggccgtgggcgacttcaagttccccaccgtggacgcctcgcgcgtcgtaccggtgtggtggggcacctgcaagatgatggggccgaatgtggtgtggttcggcgacctcgaagtcgtgacgctgaagaagaaggtcaagaccggctggttctcgtcgaagaagatcgtcaccgggtacaactactacctgggcgtgcagctcgtgttcggctacggcccggcagacgagttcatcgaactgcgcgtagacgacaaggtggctgaccttgtgcgctcggtgttcaagtacaaggacacgtggctggccggtcaggtcgcgagcaaggagttcgtcggcgacaagtgcgagttctacatctgctcgccgtccattctcgacaacggcgacccgccgagcggcgtagttggcaagtgcgttctgtaccaaggcacgttcacgcagggcacgaacaactacctctccggccagtggaacgaaccggacatgtccgcgttccgcccgttggtgcatatggtcatggagaagtgctacctcggcaacagcgacacgccgccgcccatctcgatcattgctcgccgctgcccgaaccagctcggcctgaccggcggccgccacaacgtcaacggcgacgcgaatatcgcgtgcgcgtcgtatgagttgatgaccaacaacatgtggggcatgaaaatccctgaagacaagatcgacgttgactcgttccgcgcttgcggcaacctgctggctgaagagtcgctgggcatttcgatgctggtgcagtcggccatgctcggcaaagacctcctggccgaagtgctgcgccacgctgacgccgtggtgtacgccgatccggtcaccggcctgtacacgatgacgctggcccgtgagttctcgcaggccgagaaggacgacctgctggttattgacgacagcaatatcctcgaagacagcttcgacttctcgcgcacgtcctgggagatgacgaagaatacgatcatcgttgagtacaccgaccgcgcctcgttcgagaccaagccggtgcagtaccaagacctcgccaacatcgacgtgcgcggcggcatgatcgacgcggagaccttcagctacctcggcttcagcaatgacactgcggcgatgaacaccgctgctcgcgtgtcgaaaatgaaagcgtcgccgctggtctcggcgaagatgtcgctcaaccgcatcggctacaagctgcgtcccggctccggcttctggctgcgcaagccggatcgcggactggcgaacgtgctcatgcgcgtgatcgaaatcagctacggcaccctggacgacccggcgatcaagatcaccgcgatggaggacatcttcgaggtcaacgctgtagcgtacgtgccgccgggtccgggtgattgggttccgccggttactgctctcgcaccgttcgctgcgcagcgcgtgatcgaagccccggcattcggcgctgacgatatgagccgacgctttctcatcacgatgggcgtgcccgcgagcaacggcgtcatcggctacgacgtgtggagcgaccccagcggcgcgtcgaattaccagatcaccaacgtggtcgagggctacacgccgtctgctgttctcttggccggtctgtcgcgcactggcccggaagtcgacaccgcaggcttcaccgtgtcgtcggccatcgggctgaccggtcttgacccaggcaccgatggttcgcgagaggcaggcgagaacctgctgctggtcggcaacgaactcatggcatggaagaacatcgtcgacaacggcaacggcacgttcacgatcaccggggtgtaccgcgctgtgctcgacaccatcccgcaggatcacgctaccggcgcacgcgtgttcttcctgtccgaaggtgcgggcacgaccaacgtcgacggctactcgggcaacgtcacggtcaacacgaagctagctccgaagaacgtgtcgtcgtcgctcgacatcaacctcgcagcagccgtcacggtcacgaccaactcgcgctctctgcggccgctgccgccgggccgaatccgggtcaacgccgcgccggtcggtgctggatcggccttcaccggggacatgatcttgacctgggcgcaccgcaaccgcctggacgggactatcgcctcccaggccgatccgtcacgtacgccggaggaagggacgacctacaacatccgggtctacaccggctcgaacgccctactggcagaagcgcttgcggtctccgacgctgctaccgccgcgaccatccgcctcgcagtagcaggagacatgcgcatcgaaatcgagtcgatgcgggagggcctggcctcgtggtcgaagcaggtggcctacttcagctacactccggccagcggcacgatcacgaacaccatcgcggtcgacgagccggagtacgttcttgacggaggcggcgcgtaatggcccaggtagttgttgcccaacgcatgtggcagcgccgcgacgtagcggcgaactggcaatcgaagaacccggtcctcgcggccggggaaatcggcgtgcagctcggtgcgacttcggacgagaccaagttcaagatcggcgacggcgtgacgccctggaacagcatcggtttcttcgaggggcggctgatcgaaatcggtacgggcggcggctacatccgctggcgctacgtcggtgacgagaactggatcaacctcgtgtcgctcgaatccctgcgcggcccgcaaggcaacgcaggcgcaaccggcgcgaacggcctgagcgcgtatcaggtggcggtggcgaacggattcgccggtacgcaagctgagtggctggcgtcgttgaaaggcgcgaagggtgaccccggtatccaggggccgcccggcatcccatcgcagcgtcgcatccagagaatcactgacaccaccagcggctcggtcatctgcgactggaactcgtacgacgaaatccgagtgacgctcacggccaacacgcagatcaacatggaaggtgctctggacggccagggttgcgttctgttgctgaagcaagacgctgttggcggccgtgcggttaccttcagcaacaatgttcgattcaacaacctcatctcgacctacaacgccacttccacgccgggaaagtctgaccgcatcggtttcgtgtacgacgatgacgacggcttctacgatgtgcaggccgtggtggatggaatctgacgatggccgacgaatacaccccgccgctatcgcccaacatcgtttgggtgttcaagggcaacgagtacaacccgccgctgtcgcccaacatcgagtggattttcggtgctgacgatgacggaggtggcaacgagttgcgcaagtcttcctacatgcttctcttgactatgtgaggttctgaaatgactgttcgagtttattcctcttctgacgcagacgctccggtccttcgcggcaatacgcccggcgacctcatcaacgtgctcgaaaagtgcctcgtcaccggctacggcagcaaggcgggcgcgggctggacgaagccgttcgctggcaccaacgtggccgcattcaagcaaggccctggctccaatggcatgtacctgcgcgtggacgacaccagcaccgccaccagctaccgtaaggcgaaggtcgtcggctacgaggtcatgaccgatgtcaacaccggctcgccgtcgcccttcccgactctcgcgcagaacccgcagggcggcaattggttcacccactacagtagcggctcggtggcgaacccccgcccgtggacgattatcgcagacgagatgttcttctggttgttgctgaccacttacccggagagcggcacgcagtattaccgcgagtgctacgcgttcggcgacatcatcccgttcaagccgggcgacaccacgcacaccatcctgttgcagaacgactcgcccgacagccccaactcttcggagcagtatccgttccagggttacagcatttcttcggcgatgaaccgctaccgcctttcggttgcgcgtgacttcaccaacctgggcggcccgatcacgctcggctggcacaacgatatgaccaagggcaacagcagttggggcaacggtaacctcagctatcctcacggccctgacggcgggctgtacctctctccggtgtgggcgcacaacccgaatgtcggaccctacagtattcgcgggatcatgcccggcatttgggttcactgccactacttcggaatcctgcccgatggcgcgttggtcgaaggccagggcgaactggcagggaaacagttcctccatcgggtgcactaccagaactccgcgttgtttgaaatctccgacacctgggatcggtaaactgaaatgctgctcgccaacctacccctaagctcgccggaaggatcgacttcgtacgcagacgctacaggtcgattttggagcggctacagcgtcgctccgatcatcatcgacggagcggcgcgttttataggcgacggtctgatctacacgaacagcggcggcgatttcctgctcggcacgaaagatttcgacatcgctttcgacatccagactacgagcagtacgctctccaccgttctagactacctgaccggcagcggaagcacgtggcaggtgtatttcagcaccgaggggcgtttgatctggacggcggaaggccccaacgaatcgccggtaatcggtacgacgagcgcggttaacgatggcaactggcacaccgtgctgttccgtcgaagggacggtgtgctgagcgttttggtggacggcgcagtggaagcgtcggtgcctcacgcccgcaactacaactacgcggtcagcacgtttgcaatcggcggtcgtttgtacttgggcttctcgtatattttcaggggcggcattcgcaacgtctacatcaacgtcatcgacccgccgcctgcacccgcacgcctcgccgcgttcattcgccgcagccgcatcggctgggacaaagtaaccaaggttgattcggtcaagaagatcgaggtctatcgcgcgcctccggccagtttgcggaaggtgcagaccaccaagtcgacgcgaggtgtcccgccatggtggggcgctccggggtcgaccaacgtgctgccgacgtacaagctgcgcggccgcgtgatgcagcgagacccggatacgcaagaagacacgccgttgcagaacgtgcgcgtcgctttgttctaccgccgcctgcatacgctgatcgacatccagctctcggatgcgaacggctacgtgcagttcaacaacctcatgcccggcgtccaggcgtactacggaatcgccttcgactcggacggcggcatcatgcagaactcggtactgtgggatcgcctcacgtccgaacccggcccttaattaatcaggagaagcaccatgaccgactcgaagaagctcaccgacgctgacatcgcacgcgcagccaaggcccttgttgtatcccaggcgaaggtgcgcgccattctcgatgtcgaagcgccacgcggcgggtttcaggacgacgggcaggtcacgatcctgttcgagccgcacaagttctcggagtacacgggcggccgcttcgacaagagccacccgcacctgagcaatccggtgtggggcgcggttccctacagcagctacgccagccagcacggcaaactgcaacaggccgtggcgctcgaccgcgacgccgcactgcgcgcaacgagctggggcatcccgcaaatcctgggcaacaactggaagaaagtcggagcggcatcgttgcaggatttcatcaaccgcatgttccgcagcgagggcgcgcagctcgacctcatggtggcgttcatccagagtgacaccgagttgtggaatgctttgaagcgcggcgattgggccaccgtcgcgagaaagtacaacggctcgcagtaccgcaagaaccaatacgacgtgaaacttgcagcagcccatagaaaattcggaggaaactgagatggaaatcaaaccgcgaatcggtgccgacttgtggcacgccatcacccaaggcacgacgctgaaggtgcgtttcattctcgccctgcaaagcctcatcttcggcgcgagtttgctggtccggcccatgcccgccccgacccggtgggcgctgttcgccacgctgccggtctacgcatggtcggcaatgctatggctcagcgggtcgctcatgctgtggcgcgtgctctccacgcggccggtgacgtggctggcttgggcctccaacgtgttcgcgctgttcacttggtttatcatctgcctgtcctatgccgccttcgagggctggcggggcttggttggcacgcacatcctggccctggtcatggctgttttctgcgtgctccgtactgaggcgactcgtagcgatctggaaacagcgtgatggacgttgagctggaagctgcggtcgacaacatgacaggggaattgacggtggatgaaacgaacgcctggaagtgggtggcggcactgctaggaacgctggtgaccggcggcgtcggttgggtcatcaagaggcagcgctcgggccagattctcgacgacaccgagaacgcggccaagactgatttgatcgagcggttgcagaagcggaaccgggagctggaagaacaactcggtgagcttttcaacaaaaccgccgccgggtacaacgaaatcggcgaagccaagcgcgcggccaacatggcgagcatcgaagctgacactgcaaaagccgctgccgcacgcgcatcggaagcagcgtcccacgcgcaaaggatggcgcaggcggccgacgacgtttcagcgaaacgactggtctacatccacgagctgcgtgcgttgctcgtcgccaacaacatcccgttgcccgcgtggccggagggggttctatgagctggttgttgaacacgaggctgggccaggggttgatcctggccgtggtgattctgctctgctggtggggcttcgcctcgcactacgaacagaaggggcgtgacgcatgcaaggccgagggcaacacgcagtacatcaagaccgaggcgaagggccgcgacgtggcccagcaggcggacaaggaagccgcggcggtcgagcagcaggccggacagacgaaggtcgagaccgtcgagaccatccgaaccgtctaccgcgaccggatcgtcaccaagccggtcagccccggtagctgcgtccacccggtcgacccggcggtgcaggccgagctgctggcccgctggaaggacgcgaacgggggtgtgccatgaccgcccgcgccctggtgctggcggccgccctggtggccctgtgcggctgcacgcaggccgttcgcccggcaccgcctaccgtggactgccgacaggccgcctcgacgcccctggaccccctaccggcggctgacgagtgggtggagtgggtgccgcccacccccgaacggcccaacggcctcgcccggctgtccgcacgggccgccgagtgggttgccagtacgctggtagcggtgaagcgggaacgcgccctggcggccgtgcaggagcgttgcctggacgggtacgagaaggcgggggcgatccgccggtagttgacagccccggcggtcggggatagctttagggccgctggtcgcacttcgcgttgcatcggcacctcggtagggaacgcaggaagagaatcggcgctcagcctgcaactggaaaccccggactaaacacccggggttttcttttgcggtcaaggccaagttggtcttgccccggttggtcttgaccgcaaaagaaaggccccgttgctgagacggggccttccgggggtggcgcgactctcgtcggtggccgggtgtcgactgcgtggttctgctgattccggttttcgctatgcgctggtccggctggaagggcaatatcgcttcgacgactcgaccataaggccgcgtgggtcagcgtgtcaagcgtccgtcgatcacctgttccaacttgccgcccaggtgttgcagcgcctccaccatctcgcgccactcgaacatgtgccgcgtgcggaacgtaccgaacgcatacaccgtgatgccgtcccagcggcggccccggatgtcgttgaggctcgctacccgcttccactcgccgcgcgatgcgcctttgatgtcggcgcactgttcggcctgtctgtcgtctccggcgatgatgtagatcatggcttaccccttgaacttctcgacgtgcttcagcattttctcgcgcgtctccttcagtccatcgtcccacgtcttccaagccgccgcgtcgatgtggctcaggatttcgtcgcgggccatgttgctcagcacggtgggcggcagagcgtccagctcccagctcgattcgccaaatcgcttgcggtaattcacgaaacgcgagtccgtggtttttgccgggttcggcggcggcttcaactcttcgatctggtcgtagttcaacgccatgcgcttcaactcgaactcgccgcccaggccgaacaactggaagcgttcgatcaggtcgcgcgtcatgtcgatgccgctcgggtcgtggtcgccgaagtgcaggatcagcacgtccttgtcggcgttgtgttcgatttcccgccgcgcgaaatcacgcacaaccgatgcgctcgggtagccgcgcgccgcgagcagcggcacatcgtaattccagcacacgttttggaacacgccgaccagtgcttccttctcgactacaaggaaaatgcggcggtcctgcgcggcccacgggtcggtgtggtactgcttggcgctggccgtcaggatgtccttcgggttattccaacgcccgcgcgcctcgaacgaacgcgtgcggtcttcgatggcgtcccaatcaaccagaccggcgatgcggccatcgttgacgaggcgggtgatgtacttataggacttctcgttgttcggaatgatgtcgcgggcaacgagctggtagtaaagctggcgcactgtcagcgtgtagccttcgtcctgatagacctcaatgatgccgttgatgcggtcgatcatttcgaggctcttcttcttgaacgtgatttcctgatacatctcgcgcatggcactcggctccggttgttacagcatgatgctcatggaatcgttgaaggtgatcgtgcgctcgtcatcggcacagcgcgtctcttccttcttgatgttcagcgtttcgctgccccgcacgcacacgaagccgtccttagtgacgttgcagaacccggcgctgtggacttcgacctcgacgttggccggtcgaagctcgatggtgacgtgccgcttcatcgccttggcgatttccgagtgggtcaggtgctcggagaagatgaaggggaacgccttgctcacgtccatgtcggcgaacgtggccttcaggatgacgtacttcatacgccgcctcgcttgcggatcgcggtcgcgctgatcgactcgatttcttcagtgaggcgaatctgctcgaccttgtagccgacatcgcgcccgtagtacacgccgttgacgttcggcatcgggaacacgtggaagcagccccggcggtgctgaagcgcggcttcgatacgcgtggtgaccgctacgccgtccagcgggttgctcgggccgttcggcatgaagcgcacgccgatgccgacgtagccttccttcgcgagcacctgctcgaacagcgccgcgtggcctgcgtgccacggctggtagcgaccgatcatgagaccctgggggatcatgaagcggatcgcctcggcgatgtgacccatctcggtcgtgtccgcccaacgttcggtcacgtagtccgcgttctccggcggcacgaacatctcgttggtgtccgggtagcggctctcggcaagggtgttcatgaagacggtcaagtccgctccgaacaccgcgcgaatctccggcgtcggcgcaacgaagtcagacacaaccagaccttcgtgcgtgtcggcaacagcgcgcatgcggtgcgcctgctccatgcggccttccagcgtgaagtcccaattgttcgccgcctcgcgcacggcatcgccgttgacgtgagcggcgttgaggcgcgcggcgagttcccgcgcgaaggtcgacttgcccgagccgggcaggccgcagatcagaatacgcttagccattgtgctgttccttttcgatgcgaagttcttcgcggatttccatgagcagtttgccgagatggttctcgcccttcccgtcgcacacgccccaatacttgtcgccccaccaattgccttcgacgagggttgcgttgccggtcttcagcagcttcgacttcagcggctcggtgccgaacttctggcggagcagctttctcatgacgttgatcttgttctcttcccatccgtcgcgcagcactacgcgcttaccgcgccgcttcgcgcctgcggcgtccggctcgttacggatgcgtcgacgttcgtccatgtcgtcggtctttgcagcctggaacgcgtgctcgaccgtccggtaggagtggccgtcgaaaacgacagcgcacgaccagaagttcgagaggaagcgatacgggcctgcgaagctgccgatggttttcatggtgcctcctagtggatgatcttggccttgccgaacaggatgcgctgcttctggatgtcagtgcgccggatttgttcttcgagcgagacctgcacgttggtcttcatcatcgcgtgcaggtggcgcggctctacgaccttcccggtgacgaacttgtagatggccgagagcagcgacgggttatgcagctcgaagaaactgccggtaagcacccaggggttgtgacggatgctgctggcgatttcgatgagctgcttctcggcctttcgcagatcgagcggcggcgtgatgcccagggtctccatgctgtgcgccacttcgcgcgcaggccgatggacgatcaggaactttgcgccagggaaccgcacgacgagatggtcgaaaaagaacatcgcggccacgtcggagatgaaagccgggccgggcggcatgccgtcaacaaccaggcccagctcgttgatagacgcgcactgctgcaacgggttgtgcagagacgcgcagccgtggccggtgcccgggcggacgaacgcttccatccacgcgctgcgactgcgcggcaggctcagcatgatcgtcaggtcgtggtactcacccatcggcgttctccttcagccgcgcttcgagcaaatcgcgcatggccgatgcgcccttgcccagcggcacgtagaaatggacggtggtgctgtccatcgcatccatgaagaagtgcttctcgtactcgaaccggtgcgagggggtcggatcgccgacaggcagctcttcctgcttgacttcatgcgagtagagctgcggcggcgaggccgggaacaggaggcgctggccgtccaaggggccgccgatgaaatacgcccgcgcgctcatcgctcgcccccgtccccatgcagcacgccgcgctccttgcggtcggccagcttgtcgcggttgcccttcagcaacgccacgtagccgccgctgccgcagtcgaccaggggtgcggtgcgctcggcgaactcgaacgagacgttgaccatctgctgcaatgcctgccgcatttcttccagcttcgcggcggccttggcctcgtcccactgcatgccgtcgcgcatggccttcttgacgacaccctggacgatgcccgcgtgagtgcagagcgccgattgcagatcgaagccactgatccgggcttcgcggtagtgcgcgtcggcgaggcgcgtggctgcgttgcgcaccatgatggcgaacggcggcaggcccttctgctcttcgcacatgcgggcgatgtaccactgcacgtcgcccagctccttccacgccttcgcgtatcggtcggcgcggtagtcgggcttgaccgcttcttcgtcgaacagttcggccagttcgccgacctcgttgccgatgcccagggcgacgtacaggacgcccgcagtgatcgcaacggtgctgagcgtggtcggatacttcgcggtggtctcggtgaactcggcgtagcctgcggccgctgcgtgggcggcgttgacgaaggccagtcggtcttcccgcttcagagaaagagtgctcatgtgggtctctcaggtcagggtgtggggaaagtcggaggcgtactcaatctcgaacaccttcgcgtcgtcgtgcagcaccagcgtcggctcgccgtgcggcggcgggacaaccgcgaagtcgacaccgcgcgtcagctccgtacgcgagcctacgccgtcgactacctgctcgacgaagatgcgcacgtggtcggggcgctcgcgagcggccagtcgctcacgctgcaagatgcgcttggcgaccttgccgccgaacgccttgcgcagcttctcttcgacgctgcccttgtcgcgggtggcgaagatgccggtgcccggcttgcccggcactccgcgcttgtcggcgcgattgtcggtctcgttgtcgcgctgctgcaactcgaacaagcggcgctcgtctgccgcgagctgcttcttgcgccacgggctgagttccttcccctgcgcttcgagctgcttctccttgtcgtacgtgcggaacacgcgacgcaggctgcggttgatattgatgtcggctttcatgagtgtccttgctgcggatatgaaaaagcgacccggccggtattcgacagggccgctcgttgtactactcggtcaaggccgacttagcgaccggcgacgaacttggtctgcttctgcaccttgccgcgcttggtctcacggaacagcacgatggtcgtgttgtcgtcggccatgatgctcgcgtcttccagggcaccggcttcggtgatgaacggaccctgcatgccgcctgccttctgcgtgccgtcttcctgcgcggtcagcagcaggtaggcgaactgcttcgcgcccttcttgccccggcgcacgccggtcttcttcgcagccttcttgcccggcgggcggccgcgcttcggagcatcggcggcgaccttcttcggcgcagccttcttgacggccttcttggcggcgatcagcttcttggcacgcggcttggcagcggccgtgccggtggccttggtcttcttcggtgcggtcttcttggcgggggctttcttcgccgccttcttggttgcttcggtcactgcttcagcggtggcgctcatcgggtatctccattgcgttgttgtcgacaactcgcgggatgcgagcagggttcccttgcgggattcggttactcgcagcccagcgtggagccagggtgcgaggggctgtcttgcaggtattccttgaagtcgcgccagccgtctttgcaggcaaagccccagcggcggacaatcgagccggtcatgaacagcgtccagcacggctcggtgttgttgccgaacagctcgatcatgtgcatgtgcgtcggcggcagcttgcggaagtcgccagcgtggaactgctgggtgtagtcgaagcggttctcgccttcgcgcaagccgctgttcacggtcacgctgccctcgacgtatgtgcggccgtcctgcggcgagaacaggtcgctcatcgccatcacgtacgcgcccatctgcttgttatcgaacgcagggaaccactcgctcgtgtgctcgatgtagcggccttcgagaatgagcgaggcgctggcccacgggtggtcgtgcagagcgcgctcgtcgtcaccgtggacgaacttgtgcaggtacaggttgagccagcggttgcgcgggatcaggtgccagcgggtcaggtagggtcgacgctcgccgccgttgacgccatccagggtgatgacgcggctcggcttgatgaagcgcgcgtactgcttgaacgcggcgacgaacaggaaccagaggccgagcaggcgcagcgcgttgtagaagcgacgcgagactttcggtgcagtcatgggtgcgatcctcgggatgacggggtagttcattcggcgtccagatcgttttcgttggcttcggtcaggccgccggtcggagccggaaccgcacgagtgacgagctgcggcgcgggggcgaagtcgatctggtagcgctgacggaggaacttcagattttcctcgatacgcttctcgaagatttcggccagctcttcgcgggtcagctcgccctcgtggtggccgccctcgccgacgacgcgcagcttgtcttccggttcgccgtgcgtggtgaggttgcggtagttgtgctgatcgaggatcaacttgtcgagcgcgtcgcggactttcggcaggtcttgcatttcgattttcatgttgtctctcggcgtgagaattatggggtgccgtatcgtggcaccggacgccgggtttgcacttcgtcgcgagggggcgcgcttccgtgctaccgggagactggcctcggcccgtctcgttgcagctcgatcttacccggtggggagtccgaagtaaaatcgctactgcggggccactctatcgccagctccggggcttgtcaacacccctccgcgaatccggcggacggctcagccgggccatctttcgctcccctcggaacagccggtcccgcagcatcttttccgtgacgtgcgggcagttgcgttgaatctggtcgaaggtcatctcttcgccgtcgatccggtagagcctgaccgtccccacgcgcggcagttcacccattgcgtgcgccccgtccgtacgtttcgaggtacacacgatgcagctcttcgtgtgcgatggccttgcggaaccccttctggccgaccagggcgtgcgcgaagtcgtgagcactcggttccgggttgccgatgtgctccgtcatgcgcagcgtctcgttgatgtacgcctgcggctcgccttcgacgtagccctcgtccgcgagcaacccgtggatcgcctcacggtacttccggttgcgatgcttctccgcgaccagggctgcgaacagcgtgaggttcgagagaatccagagcgccgtcgccgcgtccatcactcggcctcttcgtcgtcttcgacttcgcggatcagcgacaggtcgtacatgccgtcgccccacttctcggcggccagcgggccagcctgccgcgcgtcctcggcttcgatgtcaccaacgtggcggccgtctttcacgatgcgatatttgggcattgcagttactccggtttgggtgagatgtgcagggtgtcgagaccctgtttgatgcgcttttccacgtgcttgccgaactcgctcgcatcgccgaacaggatgtcgaggtcagggtcggagcactccgctgcgatgccgcgcattacgtcgagcagcatcggcaggtggtgttgcgagctgtagttctggtggatcatcggccacgcgccttgccgcttccaccacgtcttgcgttcgccctcggtcatgccgacgtagatgtcgatcatcgcgcgggccaggaacggcgaccagaagcaggtatcgaccggcgtgatggagtcgccgaactcatcgagcgcgaagtacaccgcgaagatcggcacgccctcaacggtgtagaccggctcatcgagcatgtccttgtacgtcgcgatggtgtagccccggtaaggagccatgtgttcgtagcggcgcttctcgggcggcgggaggggcattggaaagctctcgttgaagtacgggtctgcggtggcggcggcatgcatgcacgcctgcggcgggtcacgtgcggcggcgcgcatggccgcgtagttgcggtcactcatgcgccgcctgcgtctcggatcagcacgacaggctcaccatcggcgtccccgtcaggcaggcatgcggcgagcacgtcggccgcgccctgggcgtcgccgagcacgagcaactggatggcggcgcggatcgcggtttcggtctcgactgctttgcgttcggccgccagcacgtaccccgcaccgtcgcacagctcttcgagcagatgccgcaaccactgtgccgccgtgaggtctttgcggtccaggctcacgccatacttcttcagccctgcctcggcgcgctggcggatgatcgcgatgaggtcgtccgtggtttgcatgtcgctcatggtgtttctcctagtagcggcgcgtcggcgtcttttcgacaacgcggatgtcgtgggcggggaaagaatgctcgccgtcgttctggtcggtgacgtggacccaaccctggtcgaacgtgcagctcttggcgttgcggaagatcagcggcggcgctccgttaaacgtgatgtcgactcgcatcacagaaccctcgtcgtgatgtgcttgcacgcgccttccgtcaggcggtagtcccacatgctcttgtgcttctcgcccgtggccgcgtcgacgatccacgacacgtcggaaacgccgaaacacttcacgcgtgcgatgccgatccgccagtcgtcgccctgcttggcctgataggtgcaagcctggaacagcatcgcgttgctttcgtcggcctcttccttctcctgcttttcgatttccagcatctcgggcgtgatgagcttcagaccagccgccctcacgtcgatattccgaccgtcagacatgcggatgctcacccacgtgccctccatgttgttccacacttcgttgatggtggcgcgctcgcccttcttgatgccgtcgatcttgcgtgccagtgccgtcttccagtcgccgggcgacatgtcgcggacggcttcgacggtgtagcccgaaatgacgctgataggggcacccgccacgttctcaaagctgacccgacctgcgagtccagcgtagtggtcgttcatgtcaaaactccttgtggaaatctttctcggcccggatgagagccgaaaccttggggccgaactttttcggcgtgtcgagcaggatgtcggcggcaccgattgcgacctggggcgagatgaaatagccctggatcggatgcagcacttcgccgaactcgtcgacgatgtagtaggcgacatgcacgcccactccgtcgagcacgatcagcgggccgccgtcgctgcgcacctgctcgctgtgcagctcggcaatgaacacgtcgcggtatggctggatgcgcttgtacttcatgcggccttttccttcaggtggtcgagctgccagcccgcttcgattgcagcgaagagccgcagctcgctcgcgtcctcgtggtcgagcttcagcagcgtcacgaaagcatcgatcatctgcggcgtcattgggcgcttgtcgtagaacctgcggtacgcgctgttcgggtgcatgtcccacacgtcacacaagtcgacgattcgcttgccctcttcccgcaggtgccgacgcatgatgtcgcgcgtggtcttcgggttcttctttaccgtgatcttacggccggtggatggacggaaactcacagcccgatgtcctccgcttcttccttctcgtgttgcttcagccaatgcgtctccggcaggaacgggaacgggccgagccaaccgataacgttgccgtactgcttggcgaacccgtactgatcgtgccaagcgtcgcgacgccacacacagacgcggaactgcttgtagtgcggcgactggcccggccacggttgcaacagcaccgcgtagtagcccatctcgctcgggtcgtcgagcacttccatgtcgttcagcgagagcggcccgtaccacccgtaaatctgagtgtaggtgcgcgacttgtgcagcgtctcgaaccacccgaagcggtcgttgaactcgaagacgtggtacgcgcgtcgcttgctgttgatcgtcgggtagtcgcaaacctgcacgatgtagaaaccggcttcggtcacgtcttccaaggcttcgagttcgagcattacggcagctccacgtttgtgcgcagcgggcggatgcggggcagcgggccgacccaaccgtggacttcaccgcgatgctgctggtcgcttcccaggtagtaccaatggccctcgtaccacacgaggaacgcgtcgacgacgaggttcacgaccttggggtgatctacgcggactgcgtagacccccgtttcagtcggatcgccgatttcttcgtattgcaccttcacgggatgcccgcctttgccgtgtactcgctcaacttgcgcacccagctcacgcgatcctcgatagggatcgacagcagcgaagcatggccgaactccttcagcatctccttcatcacttcgaggcccttatcccggccgaacgtgttcctgaatgcacgcgaggcgtcacgggacatctcaccgatccaaccttccatctgccggatgcgctggtcccgcttctcgacgttggcgaggcgctgctccgcgagggcttcgacttccttcagcgaatccttgaaggcaatcagctcggattcgacctgcacgccgccacggaacagcgtgcggatggcacggatgatgagcgcgcagtcgtcgtacagcacgcccggcggatcgtagtcgcgccaacccggcacacgacggtccagctcgcggccgatgacgcgaatccaacgcaccgcgttctcgccctcattgtgcgtcagcatgtcttcgcggacttcctgcatcaccgcgccgttgtcgttctcgatgtcgatgtagacaaccggcttgacgttgccctcactatcgagcggacgccatttcgcgagccactgtgcatgatcgcggaaagtgtgcttgttgcgaccgtagtggacgccgcccttatgcgtgtccagcgtcaccgtgtgcgtgttgaagtccccctgctgcacgtcgaccaccgtgtagatgtgctcgctgccgacgcgctggtactgctcgccgaccttcggcggcagctcattgccgtggaagggcacgccgtcaagcacctgctgcgtggcgtcgacaacgttcctcggcgcttcggcttcagcgacaaactcagcctcgacaccgctcgcgcgctccgaccgcaggaacgcctgggcgtcgagctggtacgcgtacgggccgacgctgctctgcggcgacagcggagccagggcggtctcgcggtcgacaggggtgaagaggtcagcccacgagcgcgtgctttcccacacacgatcttccggctcgccgtcctgcaagcagtgcatctcgacatgccagtggcgcacgcactgctgcaagccggtcacgcggtagaacttcgtcggctcagtgcggctctgccagtaggagttgatcgagaacgccgggccttcgttgtagttcttcgagtagacacgttggtcgaagctctccatgccgaccttcttggcccacttttcgaggtcgccgatcacgtcgccagtgtcgacgcgcagctcgatgttgacttccttcttgcctgtgcgcgcttcgatgtccagcaggtcgacgcgcagcaggtcgagaatgcccggcgagagcagcatggcttcagcgatggcgtgcgggtcgatgtcgtcgagcacgatatagcgacggtcattgtccttcaggaagtctatgctgccggaaagcatgtggagctgagtgcccgggaacaggtcgcgccccgacgtggctcggaacgccgcttcgctcttgccctgaccgaagctagaagtaaagccgccggagtggaagcccggctgcggcgacggcacgacgccgttgtgcgattggaacatcacgatgtcctggccggtgaacgtgactttggcccactggaacatgcgctcagcctcggccatttgaccgtcatccaggccgatgtggtagccgcgtcggcggtggatagagaagacaatgccctcgtcgttgcaggtagcgatgaggggcagaagcaccggcttcggtgcgttgttggtgaactgcttatcgtacatatcggcggtccttggttgggttaggtggtgcttacgtggcctgcggcttcgcggtcgagttgcaggtcggccatgcccagcaactcttcgtcccaatcgtcaagcgacatccagccgttgacgtgccagtggaggtcgttgagcgtcagcctgggccagaagtagctgtgatccagtttgttctgctcgatgtagcggttgagtgctgcgccccacttctgcgcctcgacctcgcgccacgtcacttcaccctgaccgtggcacagcatgcagatgcggatgtagttgtcgcggagctgcgtggctccctcgcacgccgggcacacctgcttgtcgcggagccagcgggagagcaggcgcatgcgttgccatgcggccagacggattgcagcgagcagtagggtggtggcagcacgcgcgcgagacaaagggggtactcgggcattctgaaaaaccgaaaccctttgggccaacattttgcccttctccaattccatcacggtgtacttgcgcatggccgttactcggtgcgagtgatggtcaggaacgcgaacatggcgtcgttgctggccgtcatgtacgagccgcgttccatcgtgaagcgcttgcttgcgtgctcgggtgcgctgcgcaccttggcgatgccgccggacagcaccgagttcttcgccttgaagaacgattgcgcctgggacgacagcgtggggccgttctctactacgaatcgacgcacgtggcccagcgactcgccgactttgagcttgctgatctggtcgttgagcgagccgggcaggaacaggacgcgcggcttggcgaccttcggcttggcggcggtgctcttccgcttggccgcaagttccttcttgacggtggtcggcatcttgcgcggcttcttgggggcggtcgtgctggtggtgctggcggatgccatcgggcgaatctcctgtgccgtggttggagtaaagggacaggacaaatactactgcgcggccgggggcagttgtcaagcgcccggttctcggtcgtgaccggccgggagctggccgccctgctgcacaaaggtccggctgggtttccgaagcgggagaaaaattgggtccggctgggtctccgaagcgagagcgcgctggctttcgagttcggtttcggcctgccgtggatttttggaacgggctgactttccgaagcgggggctttttctgtaccggaggcatacgtgtacgcggacgcgcgcacgcacctgcacgcacacccgcccgcgctcctgcacaggtcacgcgcctcacctgcgggcgcgtgtcaatgaacgcgcgccgcgcgcggttcgttctcctggccgcgtcgctcatcctgggaagcgctgaacgccgttcagaaaaataattgaaaaaagtatttgcactactgcgcgaggggtgctgtaattcttccaccggcaggcaacaccgccccggcaactaacaaagggaaagcaaccatgaacgcaacgaaccgcaccgccgccattcgcgaagccgccgccctggctgattcgatcatcgaacagcgcacccgccttgccgctggctgggatcagggtatgaagcgcgacgacgaaccgcgctttaccggcgtcaccccgcgcatgcggatggaacgcgacagcgccgccgctttcgcactgtccgcgcagttcgccaccgacgacgtgcgcgaaggcggcgcggttcgcaacgtggttgccaagctggcccacgacatcgctacccctgtcaccgatacggagattcgcgcagccgccgaccgtgctatggcgctggcccgtgacaccctggcgcagcgtcgcccgttcctgggcgtgttcggtgccgccgatgaatccggcatcgccgacgctgcaatggcgaaggtgtgcggttatgcctatctggcgatcatccagaacaacaccgtgagcatcacgacggacgccgacggcatgctcacgaaagcgtgcctcaatcgtgctggcgtgatcctggccgctggcgacgccgttaacgccctggtgcaggcatgagccgccgcagtcgctccgactatgacgcgcacgcgggcctgtccgctgcgcgcagcaccgcaccgcgtccggtgcgcaagcctcgcgcctcgctccccgtgtcgcgcgtcctgggctggctggcgtgggttgtcgtcgccgcagccgcctatcactacgcgccgcgcgtcgcggcccttgtccgggagttcatctaatgcgcgctttccttatctcgctccctggcgtgccggtgttcaccgtccacgccgatgaccgccgcaccgctcgcaattacgccctgggcttgcacggctacaccgtgcgcccgccccgctttatcaccgtcacccccgtctaaggaatcgcacacatgaccatttccctttcccaagcgttcgcacagtggcaggagttagccgccgacattccgaaggatgacggcccggccctggccgaatcgtggaacgactacaccgattcgctttgcaaagacggcgagttgtgcgcgcttcagtatcactacgcgcccgcctatgacgacgacatgcccggcgaaggctcgcgttacgatgaactaagcgatgatcgcgctttcatcctggaacagatgggcgtgaccatgagcgccgagtttgtgccgtttcacgcgtcgcgcaacaaagatgaaaaatcgccgtcgcttaactggcgcgtgacgctgaagaagggcgaccgcgaagtgttgacgacggattacatgcaaggttgcgggcactgcccggcggaacagcgcaacaatttcaacacgccgaccgtcaacccgaaaaccgaaaagcgcgccgccattgcgcaggaatgcgatacggggttcgaggcgaagggcggaatgatgggcggccagttcaagcgcggccgcaagctagagccggaattggtggacgtgttttatagcctcctgtccgactcgcgcgtgttggattgccgcgacttcgccgattgggcgagtgattacggatttgattccgacagcatcaaggcgcgcgctatctatgacgcgtgcatggccgatgcgctgaagatgcgcgccgcgttcggcgataaggcgatgggcgagcttcacgaactgttcgagggcatgtaatcatgagcgacgttatccactcctataccctggaacgcgacggccttacgttccgcgtcgatcactgcgccgacaccgacaacggcgcaccctgggaaaacgaagatggtcacggcaccgtgtccgactggactacgcgcgacaagtcgccgggcgaattggtgttgaacaccgatcacggtagcaaacgcttttatgacttcgccgacgcgtgccgcatcgcgctgcgcgacggctggggcgcgcgtggcgctgaagagggcatgagtaagcgccagattgccgcgctcgccgctcgcgaggattacgaacaccttcgcgcatggtgcaatgacgaatggagctatatcggcgtcgtggtgacgttgctggacatcgaaggcaacgaaacggacgcgacggattcgctgtggggtgtggacgataatggcgactacgcggccaccgttgcgagcgattgcgtggacaacgtgatgcacggcatttcggccatgctgtatggcggcgacggcgcggtgtacatgagcggttcgcgttcgtggagggtgaaggaatgaatatcgacaaccccgcccacggttacctgcgcgacgcgttgcaggccgcttacctggaatacctcaatgcgtttttgacggttgcacgtttcgccgcgcatcacgacattgacgaaaaaaccgcatgggcgattatcgacatgggccgccgtatccacgaggagcgcaccgcatgaacgtcctgtcgcatggcgaacacgtcgcctcaatcaaccgcatgcataaggccgcagacggctacacgccggaaacgccgtggttgctgctgcacaacactggccgcgtcgaccgcttcgcaacgcaacgcgaggcaaaggaagaagcgcgcaagagctacccccgcgttacgttcgaggtgcgctaatgatgactttctcccttgtgttggtgttgatcctgggcggcgagcggcacacgttcgtcatggatagcggcctgaccgcaggcgattgcgtgcaagccctggtagacaaccccggcgcgcctttgcgctgcgaaaaggagtgaccgacatggccgattccctggaacgtctcgccctcgccatgcgtgcgcaggccctcatccaccgcgagcgcggcaggcacaaccgcgcaaaggaattggaggggttcgccttcgccgtggaaacgtgcgccgccctggatagcgccacgttcgcgccaatgccgtttgccgtcatgtgtcacaccctggccgaccgctgcgccgacatcctgcgcaacgatgatgcgcaagtgcgggcgggtcagttcgagcgactgcgcgacgccgaccgcgtggccgtgtctcgcctgcgcgcttatgcgcatggcgtgggcgatgaggcagacgccgcgcccgaactgtttaaggagacgcgcccgtgagcgttcgcattgtcaaaagcccgggccgcgctaacttcccctgggcggtgcagttcaagccgactgaaaattggtcgactgctgcggcctacgccgacaaggggccagcggtggagcacgccgaacggttgcaggcggaatatccgcatctgccggtgcgtgtgcagcactacacgggagggccgcaggcgtgacgccctacacgtattggctgcgcagcactgaccccaaggcgcgcgtattcgtggctgaagggccgcacgaacgcgacacgtcgctagcgctcaccgcgcgccgcctgggcgtcaaggtgtcgacctcgcgcggcgtggccgtgtatggcctggacacgacgccggttgtgcgcgtggtgaaggaggattgacgcatgaccctggaaccactgaccgaaaccgaaaagcgcaaaatcatccgcgcaaacattctggccgatagtctgctgcgccttgtgcagtgggttgcgttcctggcgatcctgggcgcgcttgtcctgccgctggcagtgcaggcgtggcacaaggccggtgcgatcaccgccgccgtggtgcttgccctgggcgtggcctgcgcgtggcacgtcaagccacacggccgcagctacgcggcgcaggtgcgggacatcgaagcccggcacaagccacacgaataaaaccccgcacccccacacccccacgtctgccactgtctagccctcgctcacgcgggggctttttattgcgcgttcgtctgtccctgggcgctcgccctggccgcctacccttgggcgcgcctttccctggtaacgctatggcctgcgcagtgagcacacctgcgcgcccgcatttgcgcatttccgcattgcgcacgtcctgctgactcgctaacggcctgcacctgggcgcacgtcctgctgatttgtggtcgacctgcggcacacccgatagccctgcacctgggcatttcccgcattgcacgcatttaatttattgcatgggcctagaggcgcgtgtgcgcgtgcgtgtgcgcattgcatttatttcccttttattcgcatcaccgcatggccgcgcggcccgcacgcacgcattgcggcggcgcaggagggtaaaagggatagcggcgatgcgagtaaaaaggtacttccggccctggcgcgggcgtcgcggggggcgctgac

SEQ ID NO: 15 - DNA, 56144 bp, Unknown; identical to SEQ ID NO: 14
  Bacteriophage Xfas105

SEQ ID NO: 16 - DNA, 55601 bp, Unknown
  Bacteriophage Xfas106
gtcagcgccccccgcgacgccttcgcgcaggccggaagtacctttttactcgcgagcccgctatccctttatccctttcccgcgcgctgcaacgcgcgcagcgcggcgcgcacgcatgcgggcatgcgatgcaataaataaattcggaaaggccgcacgcgcgcacctatgcggcgcagcgctgcattaattccacgttgccgcatccgggcagctatgccgcccgcatgcaaggccgggcagcgaataagcccgccaccatgcaaggccgggcagcgggcaggccggcacgcatgcgagcccgggcaaggccgggcagcgggcaaaataaaagcccggccgcaagcgatgcgggcacgggctcaggcgaagggatacggaaggccgggcagacgtgcggccggcaaggctgctaagccgcgcctagacgcgcaggcaataaaaagcccggcacgcggccgggctcagggtaggcgatgcagggaacgcgccgcagcgcgcttttaatcgtgcggcttgaaccgggcttcaatctcgcgcgcttgcgccgctaggctgcgcccgtgcggcttgacgtgccagcatagcgccagcaccagcgccagcacggcgagcccgctaacgatgccatgcgcccggaacgctccccatgccagcggcaacgcgcccgcgcatacgatggcagcgaaacaaagccagcgcgcgccgcgttctatgcgatacgccagaatgccagcgcgcagaatttgcgccttttcgtttagtgtcggttccgtcatgcgcaagcctcgccgtaggcaatggcatacaacggttcccgcgtgccgcgcgcctgaatctcgacgttgtatccgtcatcctcgacgcataccgcgcccggcggcaggtcgagcccgaacgcgcgcaggttccgcagcaacgcgcgcgggctcaggtcgcaccatgcaaccggcaccgtgccgcgcttgtgccagttattccacgtccagccttcgggctcgcgccatgcgtcaatgctcaggacgtgcgcgcgcggttccgcgtcgccgtatgccatgtcgcaagtgtcgcagtatccatccgcgttcgcgtctgtcgaaaacagcggcgcgggcgcgttcccttcgcgatccttgcaaccgtccagcgcatccgcgcccggcggcaccttcgcaggatcgacgcggaaataacggaaggcgcagcgcgggcaatgaagcgcggcattgtatgcgtatgcggtaatcgtcgtcatgtcgttagctccctttcaatcttcggattcatcggccgcgcggccgggctcgccgtacacgctcgcgacaagcgcggcgcgcaattccagcggcgcacggttcgcgatcatctcgcgcagacgcgcgcgcatctttgctttgtcgttttcccattgctcgcgcgcttcgctgtagtcgctgaagtattccggccaataatcatcatccgcatagcgcgaaccgcgctcatcgaacgattcaaggtccgcgccttcgctttccagatgctcgccgagaaattcgcttagcacgtcgtcggccgcgtccatgcgttcgcggttgctcgcgtaatcgctccacgtcgtttcacctttcgcccaccatttttccggccaccattccgcgctgcgatcaaggaacgcgcggcgcgagcatgcgaagcctaccgcgtgcgcgtcgtattcctgatccgtaggcttgccggccttgtccagccagcaccagacaagcccggaagaatcggccgcatcctcgaccgcatcgcggcaccagtcgaaaaactgcaacgcataatccgcgcggcgcgagtctgcaaccgcgcgcgtcatgtcgtcggcgatttgctcacggtacacgctcagcggcgcatccgggcaaaggtacgcgaacaattcgcgcgcgtcgtcgccgtattccttttccagctcgcgcgcatagtcgcgggaatacagataagaaaaatcgacgttatccatgcaatcgttttccgcgtcctgcaacgtcgcatgatcgaatccgcgacccttgaaaaaatcggcgatgtcgcgcgacccttgccagaaagacgcggccagatagcgcgcagcgttgcgccgatactttgcgcggcgcgcttccgtgtcgcgcgttcgcttgtcgcgctgcgattggatgcgcgattccgtgcgcgtcagaatggcgggctttgcgttgtttgcgatgctgtacattttcagattctccgggcttatcacggatgggaagggttaagcgtggcgcaggattgcgaacgcgccgccagactgccacgcgctcgccgtgtaatcgaaggactcgccgttgtcgccgatgcagcgatagacgggcgcaaggtcgcgcaggtatcggccgtcgctgtgcggttccagctccaccagacggaaggccgggcgcgcgatgcaagcctgcaaaacgcgcaggtccgcatcgctgaattgctgcgcggcttccgtgcggcgcaccgtgccgcgcgacgtgtagacaaggcggcgcagccattccgcgcccttgcgcgcttgcgcatccgtgacgcgcggcgcatgcgtgctaatcatgttcaccagctcccacgcttccgcagcggtagcagacggcgacggttcgcgcttgaaatactcttcagcgttcacggcatcgcgcagcaacgcgcgcgccttgcggatgatggattccgccagctcgccggatgcgatgcgctgcgcggttgtctttgcccatttgctttgcatgttcattctccaatgtagtaaaaaacgcggccatcgtctgcgcggaaaaaacggccggcgacggttccggcttcgcttgcggtttcatactgcggccaccattcatccgtgaacggttccgcgccgccttcgatgtcggcatagctggaaaaatcggcctcgcgcatgtcgccggcgatgaattgcagcataagcgcggcgcattcttcatccgtatgcgcggccaattcttcagcgtcccacgcgccgaaatgcgaaaaatactcatcgaatgcggcgcggtcgaaatgctcgccgaaaagctcgcgcgcatcctcgcatgcggcttcccacgtaatgcggccggcatcgtttcccagctcagcaacggatgccgagtaatcgcgcggcgcgatactggcgacgattgcggttacgtcaagctcgcacatatcaaaaatcctcgaacaattcgcgcaggtcgcgcagcatgccatcgctgaaaagccgcgcgagcccgacggccgttaccttgcacgcgcgccacgtcttttccgcgctgcgcgaatccgtgtcatacccaaggtccgcgcaaaaatcctcgaaagactgcgcgccgcattccgcatcgcgcattagacaattcagcacgtccgccagctcaggcgagcccgtatgcgccgcgcccatgctgtaatccgttgtcatgctcgcgcggtcgcggcgcagcgtgacgcgccagtgtgacgcgctcgcgtcccatccttcgcgcggtccatccttgcgcgttgcgcgcatggtgacgcctagcgcgtctaggatgaattcgcggtcatcgctcagcggatcgaagcgcgaaccgtcgccgggcatctcttcatcgtatgcgggcgcgtagtggtattgcaggtcgcacaatgcgccatctttgcaaagggaatccgtgtaatcgttccacgattccgccagcatgggcgcgtcgtcttgcggaatgtctgcggccaattcttgccactgtgcgaaggcttgcgaaaggctaatgcgttgcatggtgaatctcccttgtctggtgaattgttaggcgatggacacaaccgcatgacgcggcagcgggaaaccgtgcggaatccctagcaggtcgcgcacgtatgcgcgcatcgcgtctttgctttccgcgtaggcgacgacgggaagcgtagcggacgaaacgaaaagataacggcgcatgattcgggctcccttagacgacggacacggcgacggccgcgaccgcgacaaaggcggcaacggcgacggagaaaagaaacggaaggcgcgcgataaggtcgcgcaacgtctggaccttgcgcgcggtttcgaccttgcgcgcagcctgcgcgccacgcgacgcggccagcgcggcatgggcggaaaattcggagcgttcgatgcgtgccatgtttgcgaccctttgcgatgccggcgacgttgccggtatgcgtaggctacacggttccgcgcgccgcgcaagtatttttttactgcgcgcagtagtccgtttactttgcattcaggaagcgcggaaggcggcaagcgcgcccggatgaagggaaccgcgcaacgcgcagcgcgcgcagcattgacgcgcccgcgtcgccggcatgcgggcgcacgacaaccgcgcgccgcgcgcgtcgagaaccgcgcgtgatgcgtgcgagcgagcgcgcgtcgtgcgcacatgcgcatgcccgcacgcacgtacatgcaagagagcaattccaaaaacgtccccgcttcggatacccagcccgttccaaaattcggcccgcttcgcaaagccagccggttccgtttgcgctctcgcttcgccgacctagccggttccgaaattgcgcccgcttcggcaacccagccggaccttcatgcggcatcggcccggcgcgcgagctggtcacgaccgagaacgcccgggttgacacgaccccgggtgcgcgcagtagtatgtttcttgtccgcttacttccccggaacaggaggcatcacccaatggcatccgccagcacgaacagcagcgccaacactgcgcagaagacccgcaagaagccggggtcgaaggccgcactgaagaagcacatcgccaacccgcgcgtgcgcatcgtcgagaagccccggctcatcttcctgccgggctcgctcaacgaccagctcagcaagctcgacatcggcgagtcgcacgcgcgctgccagcgcatcccgctcgacaacggcaacattgccgcgatcaacaacgaggcacagaaatacttcaagcagcagaactcgatcctgagcggcggcatcgccaaggtgcgcggcgtggccgagcacaagtcgaagcggttcaagatggaacgcggcacctacatgagcgccagcaacgacgccatgtttgcgttcctcaccgtcacccggatggagtgaccgcagccatgcgccacacgcaccgcgaaatcgcagaggcgaaaatgttgggccgtaggcttgcggctcttcggaacgctccggtaccccctttgtctcgcctgcgcagcgctaccaccctgctgacccgcgcagtaattctcgccctgcggatgaaggtgcgcgctgcatggctccaactgttcgaccgcaccgtctgcccgaagtgcgaaggccacaagcaccagctcacgcacatcatccatgacgagtacgaaatgcggccgtgccgactgtgcaacgcacgcggctggatcgactggcgcgagcgcgagtcggtgaagtggggcgcagcagcgaagcgctaccgcctcaatgcaggcttctcgctcgcgaaggcgtactacctgtgcggtatgacgcctgaccagatcaccatgcacgaggacggactcgtgccgctcgacgattggccctcgtcgttgcgtgacattgcagaccttcaactcgaccgcgaggccgccggtcacgtcagcaccacctaactcaaccgaggaaacgccgaaatgtctcatcacatcgaaaagcagttccgcaataccgctaccacccccatgatcgtgtccgtcgctgcgtgcgttgacgagcagggcatcgtgcgcgaaatccatgcgaccggcggcgtcgtcggcaccagcgatgaccagcgcgcggaagcgcagcgcatgcacaagtggattcgcgagaccttcatcggtcagcacagcttcttcttcaacgcgcacgacggcaccgtgttctcggccgagaagccgcaccgccgcgagtacccgttctcgaagcagccggaaatccacatcatcaacaccatcgacttcagcccggacgctatcgctgatgcgatgaagggcacgccgagcctcatcgagcgcatcatgcgccgcgacttcagcaagacgcagacgaccaagggcgcagcgagcgaccgcaaggaagcgcgtgcggtgacggtcggccacccgggctacgagttcgcgccgaaggtcggcacctactggcaggaccgcaaccgcccggcacgcttcttcatggtcgtcagcacgcacgagtgcgagggccacagccacgtccgcatgctgcgcgtcgacaacggtcgcggcggcgagtacgaatggacgttcaccacggcgagcgcatggaacgacctgttcgcaccgacgactgccggcgctgtcccgggcaacccgtacgcgcagatggccgccgagctgcatgacgtgtcgttcaagcctgcacgctcgcgccgcgtcggcatgccgcccgaactcggcatgggctacggcctcatcgagtcgctgttccgcgacttcatcgagaacgtggagttcgacggcaccgagcagccgccggccgctggcgagcgctacttctccgtcatctcgggcggcacctacaccgtgatcgacgcgcgccgcaagccggacagcacggactactacgtgacgatggagcgcgacggcgacggccaccgcaccaagtttacctaccgcgaccatgcgacgtggctcgcgacgtggcggccggctgacgatgaaggcgaagcgcgcgaggtcgtcgaggtcgaactgcggctggacacgaaggacgccagcgaggcgctgcgcaacgtcggcgagcaggcgcacgctgcggctgaggcgatgatggacttccgcgaagccgacgccgagcggcagctcaacgtcatttaccgcgagctggatcgcaaggtgcccggctggcgcaacatgggcgcgcactacgagaacatcgacgacgtgggcctcgcgctgcgtgctatccgctcgatcaacaagcacatgcgcaactaccagcagatcgccgagaccagcaccaacgaggtcgccaagctgtcggacaagaaccgcgagctgtcgtccttgctgggcgtgcgcacgcgcgaggtcgacaagctgaagcaggagcgcggcggtgcgtgggacgcagcgcgtgtgcgccgagagcaggacaccatgcgcgagatgatgcgccactacgccctgctgttcgcccggcaccacggcaaggccgcgctgaaggaagcgctcgccacgctcgatgccgacacgctgctgggcctgccgcacgagcacttcatgctgctcgtgaccaagtgcgaggcccactccgctcgcgaagaggtctgagccatgtccaagaccatctcgcaggccgacgcgcgtcgctacaagcggcgcgtcgaagagctggaaagcgtgctcgatgcacagcgcgcgagctggactcacgagtacccgggcggcgtgcatatcggcaccgagaccggcgtcagcaccgacacgacgacctcgatcaagaccgcgcgcaagctcggccacgcggtcgtcgccgtgcagcgcatgaacggcgaagtgctgttctacgcgctgccgctgccgaagggcgagtgagcatgaaggtgcagtacgaagaaatcggactgccgcaggacacgggcgtctacgcttgccgcgtagacgacccgcacggtcgcgggctcgtcgtcgatgtcttcctcatgtggttcggggatcgctggtgctacctcaacagcgaccaatacttcaggggagaagtccacggctggatcggcccgctgccgcgcctgcggccactacgcgcgcacgttgaggcaccgcatgacgaagattgaacatctcgaagtgctcgacgatccgacagtcgaagggctgtacgccgtcgagttgacgcgcaacccgacaatcgtccacgacccgcgcatgtacgcggtgatgcgctgggcgaacggccattggtgggagcgcaggccaagcctgaagacgccgttcgtgcccttcaccggcatggtgctcggctgggccgggccgatgcgctacgaggacatcgaagtgctcgaagacccgccggagttcggcttctacgccatctggcaccacccgtacccgcacgcgctgccgcagcacgcggagatggaaattgccgtgtggttgccggagtacggccagatgcgcgggcgctggtgggacaactacggatggaaccggcaccacggctccgtcgatggctggatcggcccgctgccgatgctctcgcgcaagcccatgtggctgctgaagcgcgaggaaggacaggacatcgggctatgagtttccgtccgtcgactggccgaaagatcacggtcaagaagaacccgaagacggtgcgcgacatcatgcgccgccaccttcgcgaagaaggcaagcgtatcgtcgacctgtgcccggtgtgggacatgattccgcaaagtgcataccgccgtttctacgacaagcgcccgatgacgccgcagatgatcgacagcttcatcgagtacctgcgcctcgatgtcgacgacgcgagcgagctgcggttgttcgctgcaatcgaggccggctggcagctcgaccacctgaaggaaaaagccgcatgaagttcaagcgcatccaaccctaccgcgacgtgttcatcgccgagctgcacagcgaccaagtgcgcagcgacggcggcccgctggtcgtgctcgacggcggcattggcgtccacgttgcctactacatcgtcgacgacttcggcgaagtgctgcacccgatccaagcctacttcacgtctcccgtcatcgcgtgcgctgcggcggacatcctcatcgacaccccgaaaaagttcgacgcaaaggtttcggccttgctgcgcgttgaacgtgattttgccaaggacttttgaccatgagcgacatgcagaccacgaacgacctcatcgcgatcatccgtcagcgcgcggacgccggcctgaagaagtacggcgtgacgctggatcgcaaagaccttacgaccgcgcagtggttgcgccatctgctcgaagagctgtgcgacggtgcgggctacgtgctcgccgccgagcgcaaagcggtcgagaccgagaccgcgatccgcgccgcgatccaactgctcgtgctcggcgacacgcagggcgcggccgacgtgctcgcttcgtgcctgcctgacggagacgccgatggcgagcctgtcgtgctcgtgcgtgacgcgggcggcgcgtgagcgagcgcagcttcatcgccatgagagccgcgcaacctgagcccaagcaggcgtgcttgtacgcctcagcgtcccttgacccgtacttcaacgagagttttcgcatgccactccctgacgccagcaagcgccgctacgcacacatggccgcgtaccggggctacaccatcgccacgtacaaagacccgctcgacgagcccgtgtatctcatcggcacgacgcccgtattcgcggtgtacttcgcgctcgatgagctgggcgagccgatcacgccggtcgatacgtgcttttggtcgccgttcctcgcgatggcgatgatcgaccaatacgtcgcgctgaccgagcacgagcgcaagcagtggtggaaggcgcagggcgcgtggccgatgatccaccagaactacagcgcgcagcaccagctcccgatgctgctcgacacgctgcgcaacgtcgccgccgaatgcgctgaccctgacctcgacctcatgtacggcgatgcatcggagttcggcaaagcgatggcggcaaagatcaagaagggactcgaaacactccaccacgttcctgcgccgaaggaaggcgaagagcgtccacacgcgaggtctgtatgagctggttcgattggttgctgctggtgatcggccccaacgtcatcgctggcattgcgatgctgcggcagcgcgcgcggcacgcgaagtaccgcgaggctatccatgcgctgctcgccgatgagggctacgccgagggcgaaccgcaggccatcatcgacgaggcgctgcgcatgaccgcgcatctcggcatgaaggagccgagcgctcgcgacttcgcgcatgcgcttgtgcagcaggaagcgtttcgcaaggcagtcgctcacgagatgctgcacgacgtttacatccagacccacgggcgggcgctatgagcaggcagaaattcgacgacgaggattacgcagtgaaagaggttgcgcgcgttcggctgtacgccatcgacggcgacgaaatgacgttcgagcagatcaagcgacactgcccgcacgtcagcgagaagatgctgcgcgacaggctcttccggggcgagcgcaagatggcccggctgagccggccgccggacacgaggaagggtgttgacaagccgaaaagctggcgctagagtggccccgcagtaacgaatttacttcgtccccctacggggtaaatcacgaactgcacggggtcgccgaggcgatacccccggtcaactggatggcgcactccccagcgcttgaagggtcaacccggcggcttgcggcacgatacgccgctcttcatctcacgccgagagaaccaatgaaaatcgacttcgccgaactgccgaatatccgcgacttgctcgacaagctcatcctcgaccgccacaacctcgccatgctcacgagcggcgacaccgagaacttccgcgtcgtctccgaaggcggcatgcacgccggggagctgacgaaggccgagttgctgaccgtcttccagaaccgtgtcgacaccggactgaagacgctcaacacgcgctactacatcgagttcaagaacctcgacggctcgcagccgttgccgctcgttcgtccgcaggtcgacgtgaccaacgcggacggcccggccaccgccgacgcggcggtcgacgcatgaactaccccatcatcccgaggatgttccccgccatgatcgctcccaaggtctcccgtcgcttctacgacgtgctctcgatgatcggcctatggtcggtcttcgtcggcgcgttcaagctgtatgcgcgtctcgtctcgccgtccaaggtcatcatgctcgacggcatcgacggcggcccgcgtcgcccgtacctgacgcgctggcacataatcccgcgcaaccgctggttcaacctgtacctgcacaagttcgtccacggtgacgacgaccgcgcactgcacgaccatccgtgggtcagcgcctcgctcatcctcgacggccgctacatcgagcacacgagcgagtggtgctacgagcacgccatcgacgagagcgccgccggcatggacgcacacgtctcgtacatgcaccgactgttcaccccgggcgacggccgcacgtacgtcgaaggcagcgtcgttcgcaacaagggcaagttcccgggccagcacaagttcgactacacgcagcagttccgcacgggcgacttccgccgcctgagtgccgaccacatgcacctgctcgaactgttcggcaacaacgacgagccgtgctggacgctcttcatgaccggctccatcgtgcgccgctggggcttcgcgtgcggcggctcggaaggctggcgtgacttcagccagtacaccgccgcgcacccgacccgcgcgaacgccaccgtgggctgcgagtgatgagccgccgcgagaagatcgtctacgtcgtgctgctgctggcctgcatggcgggcctgtacatcacgcagccgtccgagtgtcggacgttccgcaccgaagtccccgcgtactgcgtggactgaaccgaatcccgcaagggaaccccgctcgcattccgcgagttgtcgacaacaacgctaggagaaaccagatgtccgagaacgccgaagccaccgaggcgaaggtcgcgaagaagcgccccgccaagaaggccgccaagaagactgcacgcaaggccgccgcgaagaaggctccggccaagcgcgtcgcgaagaaggccgaagccgctgcgcccgccaagcgcggtcgcccggccggcaagaagactgccgcccgcaaggtcggcgtgcgtcgtggcaagaagggcgcgaagcagttcgcgtacctgctgctgaccgcgcaggaagacggttcgcagaaggccagcaccatgaacggcccgttcgcgaccgagggcaatgcgctcgacgacgcgagcatcatggccgacgacaacacgaccatcgtgctgttccgcgagaccaagcgcggccgggtgcagaagcagaccaagttcgtcgccggccgctgagcccgtggcgttgacgtagtacatcgaagcggccctgtcgacatcggccgggccgctttttcatttccaaggagcacacgatgaacctgttgaagcgcattttccgttcgtacgattccgagaaggcgaagaccctgagcccgtggcgcaagcgcatgctcgccgtcgacgagaactacgccttcctgctgcaagcccgcgacaacgcgaacgagcagcagaagaacaagcgccaagtgcgcacgtcgaagggcggcattgccggcgtcctcgcgatccgcgaccacggctcgccgcaggagaagttgcgcaaggcgttcggcggcaagaccatgcgccgcatcctgaaggccgagcgtcgcgccgcgcgcgagaaccccgaggcgctggtcgtccacgccatcgccgacgacggtgcgcgcaaccagctcgtgcgcggtgtcgacttcgcgatgatcccggccgcgcacggcggccccacgctcgtgctgcacgacatggcgacgaagttcgacgccagctacagcaacgacttcgccgaggcgctggccgccgggggccgcgcatgagcatcctgtccctcgataccgcacgcgagtcgcgtgctgcgcgcgtcgagcccacgcgcgtcttcgccgaggcgtacaacgccttcaccgtcacgaccgccaagtacccgaccgacatcgtgcagctcgccggcaacgtcagcgccggcatgctgtacaccggcatcggtctgtcgaacgaagtcggcgagctggccgagctgttcgaccaagaagccatccgcgaagagttccgcgtcgagcgctaccggaaggcgtggcacgagctgggcgacgtgcagtggtacgccgcgcgcctgtgcgccgagaccccggagctgccgcgcttcgacgtgctggtgcaggaaggcatgcagcgcctcgccgacgccgagtaccgcgaggtccgtatcagcggctacgacctgcaatcggccctgtgtgcgcacgccggccgcgtgctgggcgtcatcaagaagatgatgcgcgatggtgcgacgtggagcgccgagaagcgtgcggagaagatcgccgagttgcgcggtgcgctcgctgcggtgatcgccgtgtcggtcgagtacgccgagcgcacggggccgctggtgggctgcgagggcggctacgagaagctgctgttcgacaaccgcgaaaagctcaacggacgcaaggaacgcggcacgttgcagggcgacggagacgtgcgatgaatgcaaccgttcgaggcttcttcgtcggtgggccggctgacggcatggtgcgcgagttcgactcgcgcccaccggatcgcatgcaggcgacgccagaaggtcaaggccagctcatcccgggcgcggctccgaccatctacacccgcaacgacctgaccggcggcacagtgatctacgtgcccgccggcacgctgctgcacgatgcgttcgtccgcgtgctcgacagctacgccgaggcccggcagctcgacaagctcagcgacgagcacaaccgcgtaggaggctgacgtggcatacgagcacctgacgatcatgctgagcctgccgcgcagccgcagcgcatggatggccgagttccttcggccgttgtgcgtgtcgtcgatgcacaacccgcttcagcagtgcgcaagcatcgctgagctgggccagaagatcgacaagcagccgtccggtcgcgtgttcgtgtcggacgtggccggactgttcttcttcgaccaactgctcgtccggttcccgggcgcgcagtacctcgtcgtgcatcgtgcggcgagcgaagtcgagcactccatgcgcaagcagggcatccagccgccgctcaacgtgcgcaaggccgagcggcaactgctcgacatcgcggcgcacatccggccgcacccgtggtcgatgaccggcacgttcttcgagctgcactcgcctcagattctcatggcgattgcgaagttcgcgaccgggcacgcagtagagccgcgctacctgcaccagatgatgaatcgcaacgtgcaggttcccatccaagaccagatcactcgcaccgacatgcagaagcagcgccagctcttcagcaaggcgaagatcgacttccactaggggacaccatgaagaccatcgacagcttcaacggcccgtaccgcttcctctcgaatttctggtcatgctgcatcgccttcgaggggcactcgtaccgcaccgtggagcacgccttccaagcagccaagacgctcgacgaggacgagcgccgtcgcattcgcaacgagccgagcgccgctggcgcgaagcagcgcggcaagcacgcaacgctgcgcgaagattgggagcagatcaaggtcggcgtcatgcgcgacctgctgcgccagaagttcggcaccgacccgctgcggtcgcgcctgctgaagaccgggaagtcgaagctcgtcgaagggaattggtggggcgaccgtttttggggcgtatgcgaaggcaagggcgagaatcatctcggcctgttgctcatggaaatccgcgaagaacttcgcgcacagaaggaatcgaacaatggataagcaacacatgctcgcgctattcgtgctggcaggcatcatggtcaagcacgcggaagaacttccgaacggctactggccgaacgtgcctcactacgacgacattcgtcgaaacagcccgtggtggctcgccatgaccgagtttggcccggtcaagatcggctggcgtaagcgcgtcatctcgattgattggaccgcgacggaagtgcgggccgtcatcaccgaagacgacgtgaccaagggcgaggaatacgtgcatgcgtggacttacgcgaaggccgtcgagtacctgaccaacttcgctcaggaggcccgccgtggctaagcgaattctcatctgcggtctgccgggcagcggcaagaccaccctcggcgcagcgctcgcgcgcgtgttgccggcaacgcacatcgacggcgacaacgctcgcagcacgtacagcgattgggacttcagcgacgaagggcgcgtgcgtcaggcgcagcgcatgcgcgagctggctgacaccaacggcggcctcgtcgtcgcgtcgtttgtgtgcccgaccgaagagacgcgcgaggcgttcgcacctgacctcatcgttttcatggacacggtgcagaagagccgctacccggacaccgacgaaatgttcgagcgcccgcagcaggtcgcggtgcaagtcacggccgaagtgatgcagcccacgctcgaacgcattgccgcgtgcctgcgctacctgacgccgcagggcacgatgatcggccgctaccagccgtggcatgcgggccacaccgcgctgttccgcgagacgctggcgcgcagcggctacgtcggcatcggcgtgcgcactgtgcaaccgagcccggacaacccgtacacctacccgcagatcgagcagcgcatccaccacgcgctgcacgcgcacgccggcagctaccacatctacccggtgcccgacgtgcgcggcgtgtactacggtcgcgacgtgggctatgcggtcgaacgcatcgagctgtcgcctgaaatcgaatccatccgcgccactgacatccgggccgccgaacagcccgccaaccgctaacaggagccgagtgccatgagtctcgaacgctacaaagaaatcaccttcaagacgaagaccctgcaacagatcgacaggatcaacgcgatcatcgaagaatatcttgatgcggggtacacgctgaccgtgcgccagctctactaccagctcgtcgcgcgcgacatcattccgaacaacgagaagtcgtacaagcagaccacgagcatcgtcaacgacgcgcgcatcgccggcctgattgattgggacgccatcgaagaccgcacgcgctcgttcgagcagcgcagccgttggtcgcgcccgcaggacattctcacggcgtcggcacggcagtaccacaccgacccgtgggcgacgcaggagaagcgcctgttcctcgtcgtcgagaaggaagcgctggtcggcgtcttcagccgcgtgtgccacgagttcgacgtgccgctgctcgcggcgcgcggctacccgagcgcatcggtcgtgcgcgatttcgcgaagcgggaaatcgaagagagcgacggcaaggatgtcgtgatcctgcacttcggagaccatgacccgagcggcatcgacatgacgcgcgacctcgaagagcgcttcgagctgttcggctggaacggcgagttcacgctgaagcgcatggcgttgaacctcgaccagatcgaagagctgaagccgccgccgaacccggccaagacgaccgacgcgcgcttcgtgaaataccgccagcgcttcggcgacaagagctgggagctggacgcgctgccgccgaccgtgctgagcgaaatggcgcgcaatgaaatcctcacgcacgtcgacacgaaggcgtgggacaagtggagtgccggcgtcgagaaggcgcgcaagaagatgatgaagctggtcgagacgtggaaggactgacgaaggtgttgacaccctgagcgcatcgcattagggtcgactcatcgacgcgacattgcccttccagccggcgcagcgctccacgagcggacaccggaatcagcagaaccgccgcctcgatacccactgctccggcgcgacgccgcagcgacccgagaccccgccccggcaacgtggcggggtttctttttgggtcttgacgaacttggtcatgacgcacttggtcttgacgcaaaaagaaaccccggatggttagtccggggttcctcgttccctgcggtgcggagcgccgattcaccgcgccgctgtccctctgccgagtgccgatgcaacgcgaagtgccaccagcgggatcaaccgtaatgcagcgcctcgggcctgtcaactactgccggatgagccctttcgcttcgaggtcgtcgaggcatccatgctcgacgcggcggtacccctcgctcactcgcaccacgcccagaacgtcgatgatccagttcaccgcacgctcgctgagccgcgcttcgccttcggtcttgcccgggcgcggtgggttccactcgatccactcgtcggccttcggctcgcgcggcactgccggcgacgcaggctgcttgcagttaacgaggggcgcttcttgcttcaactgcggcagctcgcgctttgccgatccggtcttgcacccgctcgtcgagagggtgaacacaagaaccaacagcaacaggcgcagtgacgggcggctttttgtacacatcatggatggtctccttcgagtcgttcttcgcttcttcggcatcggctgcgaccttcgctgcttcggcgtcggcggccttgccgatttccgaagcggtctggttgtcggcgatgttcttttcaccttgcgcgacgttggccgcgttcgtatcggtggcgcggccagcttggcaagacgcgacgccctcgttgtagtagtgcgtcgagaacgcataccagccgagcgccatgcctatcgcgatgctgccgccaagcagcacaccgcgacccatcgccgttccgaacagccacgcgattgctttcgtccacatgctcatctccttacggggtttcgacgaggatcgcttcggcctcgcggcgcgcagacaatccgttctcattgaccgtgccgcgccacaaccgcttcatgctgcgaatctccgaagcgatgcaggcatagtcctgcttcggcacgcagttgtcgcggatgttgcgcatctcccgtcgcgagtcgccggtcatcgccgcgccacggttgtacaccagcgagattagcgccccgcatgcgttcggccgcagctccgtgaagccgttgcggaacgcgcgctcggtgcggcgctcgtactcgacgaggctgcgttcctcgaacacacggctggcgtggtcgaagccagtcgggatgtcgcggaagcgcggcagcgccaccttggccggctggcctacgatgccggcggtctggcccagccggtcgacctgcccgtggtcgtgccagtcgtcgacgatcaccgcccggggctggtggccgccgtcgtacccgatcccccacgtcaccccggacgccccgcccggccagatcggcagttcgagccgcttccggtagaacgccgggctggtcacttcccagcgtagcgtcagggccgccgcagcgcgccggcaagccgcgtcccgggccggcggcgggggtagtagcggggtaaggtccgcgagcgccgcctgcgcagccagaagcggctccgtgacggtctccgaaaccgcctgctcggcccggggcaggggttgggccgagacgacctgctcggcgaccggctccggcgtggccgctggcaggctctccacggccggcgggagcacggtctggtcgaccgggggtaccgctgccggccgggcgcacgcgcccagcaggagggccgcagcgaggactacgacccgggcgctcatcgggtgtaccagaaggtcgcgaacgccagcgccagcatccactcgatgcggtcggtccagacgatccagtgcgcgtcgcggttgccttgcttgcgcaggtcgaacagttcgagttcggtgcggtcgtgcaggtcgaaccagcaccacttcttcatccaccatgtggtgaagatgatgagcgtgatgcgcaccgcgttgagcgcgtagccgaagatgtcgccgaagccttcgacgccgatgcgagagtcgaccgacttcagcacgatgtagctgccgatgaggaagaccagcatgaccgggagctggaagaggatgatctggttgcggcgccagaactcccacgcgcgacgacggaacggcatcttactttccgggttggccgggctgctgttgttggtgtccattttctttcctctgtgattgcggaacgtagggctcttcggggatgcggcccccgcgagcgagatagagcttgatgtcggccagctctttgccgtgttctacacccatcgcgtcgatgagctgccggttgtaggccgacgacttctcgactcgatccgtgtcctctttgttgtcgttgaagcggtagttgatgttccacaggaagccgccaacgatcacgcccgccaatgcgccgattgcggaaccgaacccgacgaagcggatgacggtctcgcgcacgctgcggatttccttctccaagtccttcttgacgttttcgttctcggcttcgtgctcgcgccgccattgatcgcggttgttcgagtagtcgcgccaccgttgttcctgcttggcctcgaactcatcgaaccacgactccaacctcgcaccaagttccgacactgatttctccaccttgtcgattgctaccttgttcgagtcgtgcgcgccttgcagaccgcgtagctccgacacgttcgtcgagcagccgcgcacttcgacctgtacggccgcgagcgtggcgcttacgttctccatgccggagctgacgcgctgcgtgagcagacgcatatcgccttcgatgcgttcgagccgaatggcctgttgcgcggcgtccagaagtccccctgctttgtccgtcactcttcggttcctattctgctcgttgttgttcgggctcacggcacttctccttacggcccgggctcgggtgtcagtcgatcccaaatgaccgcgttctgcaacggtgcgccttccgggtcgaacgcgatggcgtagtacgcctgaccgcccggcatgaggttatcgaattgcacgtagccgtcgacatcggagagctggatgtctacgagcgtatgcaagcgcctgaagaacagcacgacgcgcgcgtactgtaccggcgcatccggcaacaccccgtcaggatcgcgctgcatcactcggccgcgcagcttgtaggttgggagctgcgtggtcgacccgctcggcccccaccacggcggcacgccgcgcgtgaccttgaccgtctgcactttcttcgtttccataggcgggaacgaatagaagatgctccggcggatcgccgaacgattgcgcgcacgatcccagccgaccagcgacttagctacgaacgcggaaacccggccgtacgagacaaccggctcggtgatttccagcgagacgtttcgcagcgaacctttgtagtcgtacggataccgctggtagacgcgcgttccgatacctatgatcggcgtaaccgcgtagtctcggccgtcacttcctgtcgcaagcgtcacgccgtcaagaacaattctgacggctccgctctcgcgaataatttcgacggtgtgccagttgccgtccgcaacatccacagtgccgccgacaagattgatgccgccgtagctcgggttgtacacgctccacgcaagcaccccgtcttgcgtgtagacctgccaagtccatgcgctgatagacgtgttgatctggtcgaggatgatcctgtagccgcccttgtccgctgccgccatgcgcatgtcgaaggcaatgcggaaattactgatagcgccgatcttcacccggctatcgacaggcgcgctcacgtagtcgtcgctgccgtctagcagcagcgcgttggattgaatctgcgcgttgccgttcaccgaccacgagaagtttcccgtggtgtcggtaatcgtcgtggagccatccggccccgacatcggcaggttgaagatgagcgccatcgcgcgttacctatcccaagtgtcggaaatctcgaagaccgcagtgcattggtagtgcctgcgcgccatgaacgtcttgcccgccagctcgccttgaccgttgaaggtctgcccttggctgaagatgttctcgttgtgacacggcacccacaggccgggcatgagcccgcgcacgttgtacggcgaaacctgcggctcatgcacccacaccggggacaagtacaggccgccgtccgggccgtgcgggtaggacaaattgccgacgccccaagtgttgctgcccttggtcatgtcgttgtgccagccgaggtaaatcgggccgccgagattcgtgtaggagcgcgcggccagcatcacgtagcggctcgaacccatcgtgctgctgataccgacgccgtagaacggatagccttcagacgtattcgggctgctgtcgttccacgacccgagcaagatggtgtgcgtcgtgtcgcccggcttgaacgggatgatgtcgccgaacgcatagcactcgttgtagtagtaaccgctgtcgccgttctccgggtaggtgttcaccatgaagtagaacagcatctcgtccgcgatgatgcgccacgggcgcggattggcgaccgaaccgctgctgtagtgcgtgaaccacggcaggccattcgccttctgcgtcggcgtcgggaacgaagtcggcgtgccggtgttgacatcgctcattgcttcgtacgctttcatgaacgctgcgcggtagctggtcgcagtgctggtgtcgtcgatgcgcaggaacatgccgttcgatcctgcgccttgctggaacgccgcgacgttcgtgccggtaaacggcttcgtccagcctgcgccggctttcgagccgtagccggtgacgaggcacttttcgagcacgttgatgaggtcgcccggcgtgttgccgcgcagaaccggagcgccagcgtcggaagaagagtagatgcgaacagtcatttcaatacctcacattgtcaggattagcatgtaggtggatttgcgtagctcgtttccgccgccttcatcatctgcaccgaatatccattcgatgttcggggtcaacgggggcgtgtagtcgttgcccttgaagacccacacgatgttcggcgacaacggcgggatgtagtcgtctgccatcgttagattccatccacgattgcttgcacgtcgtagaagcccgcgtcgtcgtcgtagacgaaaccgagcctgtcggacttgccggcagtcgttgtcgggttgtagatcgggatgaggttgttgaagcgcacgttactgccgaacgaaacgccgtgaccgccgacgccgccttgcttcagcagcagcacgcagccctgaccgtcaagcgcacccgtcatgttgacgagcgtgtcggcggtcagcgtcacgcggatttcgtcgtaggagttccagtcgcacacgatggagccgctgtcggtattcgtgatgcgctggatacgacgctgcgacggaatgccgggcgggccttggtcgccttgatcgcccttctcgcctttcagcgatgcgagccattcggcctgcgtgccggcgaacccgttggcgacggcgacctgatatgcactcaacccttgcgggccttgcgcgccattcgcaccagccgggccgcgcagtgattcgagcgagaccagattgatccagtcggcgtcgcccacgtagcgccagcggatgtaaccgccgcccgtgccgatttcgatgagccggccctcgaagaacgacagcgagttccacggggtcgcgccgtcgccgatcttgaacttggtctcgtccgaagtagcgccgagctgcacgccaatctcgccggccgcgaggatcggattcttggcagaccaattcgccgcagtgtcgcggcgctgccacatgcgttgtgcaacgactacctgtgccattacgcgccacccccgtccagaacgtactcgggttcgtcgacgatgatttcgttggcggtagccccggcggccggagtatagctgaagtagccgaccagcttcgtccacgacacatagccgtcccgaaccgcctcgatttcaacgcgcatatcgcccgacaccgcgaagcgcatggtgccggtcgatgctgcgctcgacacgtccagcgcagacgccagcagcgcgttcgagctggtgtagacccggatgttgtaggttgtaccttcctcgggcgtacggctggtatcggcctgcgatgcaatgctgtcgtcgagacgattgcggtgcgcccacgagaacatcatgtcggccgtgtatgcagcacccgagcccacgaccgcgccgttgatgcgcaagcggcccggcggcagcggacgcagcgcacgagcattggtcgtgaccgacatcgccgcagcgttgtccagcggcaccgtgtcgatgatgctcttcggcgtcagcttcgtgttgagcgtcaggtcgccgccgtagccgtcttcgttggtcgtgcccgcgccttccgacatgaagtagacgcgcgaaccggaaccgtgatcctgcggcatggtgtcgagcacgccgcgatacacgcctgtgatcgtgtaagtgccgttgccgttgtttgtgattccctgccatgccatgagttcgttgccgaccagcagcaggttttcgcccgactcgcgcgagcccgcagtgcccgcttcgatgtcagccactccgacgaccgacgtgacggtgaagcccgcagcatcgacttccggcccggtgcgcgacaaacccgacaccagcacgcccgaaggcgtgagcgcgtcgatggcgttcgtctgctggaagttcgtgccgccgctggtgtcggtccacacgtcgtagccgatcacgccgttgctgttcggcacacccatcgtgatgacgtagcgccgcgacatatcctcggcaccgaatgccggcgcttcgatgatgcgctgctgcgtgaacggcacgaccgcgccaaccggcggttgccaatcgctcgggtccggcggaacgtaggccacggcattgaccgcgaagatgtcttccatcgccgtgatcttgatggccgggtcgtccagcgtgccgtagttgatttcgatgacgcgcatgagcacgttcgccagtccacggttcggcttgcggagccagaacgcagaaccgggacggagctggtagccgatgcggttgagcgacatcttcgccgacaccaacggcgacgccttcatcttcgacacgcgagcagcggtgttcatcgcggcggtcgagttgctgaagccgaggtagctgaattcttccgagtcgatcatgcccccgcgcacgtcgatattcgcgaggtcttggtattggaccggcgtcgtctcgaacgtggtgcggtcggtgtactgcacgatgatcgtgttcttcgtcatctcccacgacgaacgcgagaactcgaacgtatccggcaggatgttcgagtcgtcgacaatcagcagctcgtcttgctcttcgtcgggaatctcgcgggccagcgtcatcgtgtacaggcccgtcaccgggtcggcgtacaccacgccgtcagcgtgccgcagcatttccgccacgaggtcgcggccgagcatggcggtctgcaccagcatcgagatgccgatgctctcgtcggccagcgtgttgccgcaggcgatgaacgaatccacgtcgatcttgtcttcggggattttcatgccccacatattgttggtcatgacctcgtacacggcgcacgcgatgttcgagtcgccgttgacgttgtgccggccgccagtcaagccgagctggttcgggcagcggcgcgtgatgatcgagatgggcggcggcgtgtcggtgttgccgaggtagcacttctccatgaccatgtgcagcagcggacggaacgcggtcatctccggctcgtcccactgctcgctcaggtacatattcggcggctgctcgaaggtgccgcgatacagcttgcagttgcccttgacgccgttcggcgggtcgtcgttgctgataatcgtcggcgcgttgatcgtgaaggcgcacacgtctcccgtgaacgtcttgttgttgatcggcgcaaccttgtcgtcgatacgcagttcgatgaactcgtcgcacggcccgtaggcgaacacgagctgcacgccgaggtagtagttgtacccggtgacgatgcgcttcgacgagaaccagccggtcttgaccttcttcttcagcgtgatgatcgtcaggtcgccgaaccacacgacgttcggaccttgcatcttgcaggtgccgaagaagatcggaatgacgcgcgaggcatccgcagtcgggaacgagaagtcgccgacagcagaaggcttcgggtcgttgaatttcggcttcggccgaagcagctcgccaactacagccatgacgagcgcaactacgatggctacccaaaccattaggtgatcccctgcgagaagacgttgtaggccgggaagtgatcgaacccgacgtagttgagcttgttgttgaacttgtccgcgcacacttccttcgtgcgtgcgcagccggcgtaaacctcgatgatctggctcccgttaatttcgaggaacggatacaccagcgtgatcgtgccggcggcggcgtcgtgcgcaacgatgaagcgttgttcgccggttgccgggttgtaggcgaagccgttggtgtaccagccggtcggcttggccgagaactcaggcgagcccagcaccgcaccgttgacggtcgtgaccagcgcatcgttcttccacaactgcttgtcgacgccgcagccgacttggtacaagccccaaatgcagccgctcttgaacaccgcccacgggaccgtctgcgagaggttgtcgatgatctgcgagcattcgagcgtggcctcagcgcccttctggttgaagctggtgatgtggccggtgaatgcctgcacgatttccgcagcagggtcgttgcgctggtaggcgtagatcgtcagcttgatcggccgcgccggcaggtacggcacatgcgccagtgccaccgggttgtcgaacggcatcgtgacttgcaggttctcgatattcgcgtcgccggccgtctgcttcagctcgccgcgcttgatcgactcgggcttgtacacgatggggccgagcaccttttcgcgcgcatcggtcgtgtaggcccagcgatagcggccatcgtcgctctcgaacaagtacagctccacgcgggagctgagttccttgtcgctttcgtattgcaagaggctcatgtcaatcctcggtcgtcttcgcgaccatgatggcttctaccgtagccttcgagtcggtcaggtggcggatggtggtggacggcgactcgaagcggtacagcgtgaggaagctgatacgcgccacgtcgtcgacatcgagcgagacgcccagcgacgaatcgagttgcagccgggtgaagttgtcgaagtcgctggtgccgagaatgcggcggcagaaatacgtgccgtcgtgcagctcgatgatgatgtcgcggcgtgccgggtgtgcgccggccagcgcgccgtattcgttgttctcgaccacgaggatgtcttcggtgtcgaggatcggcgcggccatgttgaagtcgaccgtgccgctcggcatgaacaccgaacgcgcgacgccctgccggcggccgaggaactgccggaacgagaagatgtcgccacggttgaacagcgtccagttgtgccggcgcgacatcttcgagaagcctgccgacgagaacgcgacgaacttgccggtgttcgagtcgacgcgcttgacatccgacgtgaaggtgaagggcatagccgactgccagttgatgcgaccgagaaacagctccttgccccggtaggtcaacggcgcgatgttgagcgcgacgttgcccggggtcacgctcggttcgcagtcgaacgcgaccggcattcggcccaccgtcgacgtttcgcgcgatccgctcatcgcatcgttcatgagcccgacgaagcacggatagatgcgcgagccttccggccagtcgtattgcaacccggtcgtgaccgtaatgccgtcgacgccgaccgtctgcacttcgcggatttcgttcgtctcgtcgtcgaggtacagcgcgaccagcgagccgggttcgagcgacaggccgaaggtgtcgaacggaatcgtcgtagcgccggccgccacgtctgcgtcgatgcgctcttcctcgccccaatgcggcacgccgaagaagcgcgactgccacgcgaacagcaggttctcgcatcgctgcgcctgcaacgccgtgcgcaggttgatgttgtattcgagcgtgcggcgcggcacttcgcccgactcgctgccggtctgctcgctgccatcctcggcggccagaacccacgagcgcatcgtgaccgtctcgtcgacaggcgagccccaattcggcgcgaacgggaacagcacgatgcgtcggccggtgatcggcacggtgtaggtaatgccctcgacagtgaagttcgcatagctgtcgatagtcggcgggccactgagttcgatctgcacggtgaagtccagctcgcgcagcggctccatctcgtacggcagactcacgccgaccggcagcgacatcgagatgcctgcctgcgggccgagcgcggcgttttccaacgtctgcggcgtgacgtacgcattccacaggatgatgtggcgtacctgcgtcgacagcaaattgccggcgtcgagtgcggccggcacgatgtagatgcggttgtagtagtcgtcgaagaagctggtcgacttgcgctggccggtgacgccccaatggttgtcggcatgcacgcgccagcgcccgtagccgccttgaaggcccgggcgcatttcgtaaaagtcgaacatcgagacgacttcggtgttgtcgtccaagtcctcgctcagcatcgcgttgttgatgccgcgctcgacttcgctgctgaattgtccggtgatgcctgccatgagttacggccccgtgtagcggatcgcgtaggcgaaagtgccggagtggttcgcgcccgtcgaccacgagacgccgttgcgcacgtcggcgttcttgcggtggaacgggtacaccttccagcggtcggtgccgtaggtgacgatttccccggacaggtggttgtcgttgcggcacagacgtgcgttcaccatgtcggcaacgatagtctgaccctgcgagagacgacgctgcgtgaccagcagcggcagcagcaccgtgttctggttgaacatcgacggcaacgcttgcagcaggcccgcaacgacatcgccggaaccgacgaggttgccgtcaccgttgtagacgcgacgccacgcagtcgaatcgaggccggtgtggatgtaggagcaaccgagcgcctgcgtgtaatactcggcgaacaggccgcagcccatgcccgaccaaccgaagccgaagccgaagtagctcgcgtcggcgctggtgtacacgagctggttctggttcgacgcggcgttctcgttgaacgagcccgagaaccacatgccggtgccgccgatctgctggatgttcgacttgccccacgagagctgctggtacttgtcggcgttgtagttgaccacgaggaacacttcgtccgggccgacgttgatgtgcaggtcgtaagtcgccgggaaattcatcggcgaaccctcgaagtccatgatcttgacgccgttcggcgcagcgccgggcagcgcgccggttgcgcttccggtgccggcctgcaacagcagttgtgcagcagtcgcagtgaggcgcaggtacatgccgttcttttccagcacgccgtcgccgttgagcccccagccgtttgcctgaagtgcggtctcgaccgaattcttcagcgatgcgaacgaggaaaagttgccggtgtagtaagccattaggtcatctccaatgcgataaagctgcgccagtcagtttgattcacgtcctgcaacacgacgaacgcacgcccgccggcagtgagaatgtccgcgacgtgatcggcgatgctcaggcccgccgggtcgacgtaggtgccgccgacctgcaacacgttctcgacgttgttgttgaagccggacacggcgtacacgccgtccagctcgccgtacaccgcaccttcccacacgccggccggcgcgctcgtggtgtacaggatgatcggctgcggctggtaattcgtgccggccggaacgagcgaacggctttggtcgccgccggtcaagtagttccagttttcgagcgcgttgtaggcgctcgacgcatcgctgccggccgggccgttgtagaacgggaagtgcgacagccgacgccacgtacctgcttgatcgcgcagccacaggtacgacggacgcacgttcgacgaagagccgcccgtatagcccgactcgcggccgtgatacgggaagcggtagtcggtgtcgctgaaacgcttcggtgctgcaccgtcgaacatgccggcacacaccagcggcgacgggaactcgcccggacgcgagtagggaaacatcttgcctgcgtagaagtgggtgtagaccggagtgccgaccttgaagcagcccgcgatgcgttgcgcgttcgcagtgatgaagtacgtcaccgcgttgttgtggcaaggcacaccactcagcttcgcgcccggctgcgagtcgaacgagttcgcggagacgtagccggtaaacgtgccgacgagcatgttgtagtagtcgccgctcacgctgctgtaggtgcggaagccgatgtagatgtcttcggtgcccgacaggccggacgagttgaggatcaactcgcgcacggtcccggtgttgacgtagcgcagcgtcgtccacccgttcgcctcagcgagcgtcttgatcgcagcgagcaccttgtagtgcgcctcgtcgccgctgccgccagtcacagttgcaattacgtgtcccatgtcgattccttatgcgagaagtttcttgtacgagctgcggtcagctttgattgcgttgaagatggactggcgtcctgcgcgggtgttcgcgccggcagcgaccacgctctcgctgtcgatggtgttaatgatggacacgtccatcgcaggctgagcgccgcctgccattccgccgttaaagcggtggcgcggatcgtcttcggtcagcacttcctcgttgcgcttcagcaccgccggcacttcgtcgggcgcgaggcccgcaacgccgcccgtgtggtagcgcggcgcagcctcgaacacgtacgccggcaccgacgaacgacggccggagccggaaccagcgaggccgccaacgtgcaggtagctcgcgaccgcgctgataatctggccccagccgccgccgctgttctcggccgccgccttcagcgcgttgaaaatcgcctgctgaataatcatctgcgcgagctggatgaggatgtcggcgatggtgttgagcacgatgtcgccgaatgccttccatgcgtcgccggcatcctgcacgcccttcagcgtgtcggagatgagggtcgcggtctccatgaacgcctgaccgaagccgttgacgaacacgtcgatcacctgtcgcttctgcgcgctgagttcgaccgacatcgcctgaatctgcgcgctcaggttttcgaggcttgcgcgcgcggcctgcgcctgcgggccgtcccccagcgtcgccatgaactcggcggccttcgcgcgcaacgcttcgagctgcggcagaagacgcgcgttgacttcctcgatccgggttgcggcttcggtggtcgtcagcagtccggcctcttgcaaggtgttgatcgcatccatcgacgactgccgctgttgcaacaggtcgttgatccgctgctcgtagaactcctgcgtcgtcgcctgctgctgtgccttctgcaactcaggcagcgaattgatgcctcgctgaatctcgcccttggccgcatccgactgaccgagcttgtcggcttcgcgcagcatgcgttccagttcagccttgcgatccgcgatcttgttgtcgatcacagccagccgcgcttcgagcgtatccgggcgcgagttggcgatgtcgttgtcgatgtcgcgcagcttctccgctacgtcctcttccagacgcagccggcgctcggcgagcgcggccagacgcttctcttcagcctcggccttcttgcgcgcagcctcagccgccttcgccgcctttgcgtcggtgccagcacgcgcagcagcggcatcggccgccgcttgaatgcgcttgaactcagccgcaagcgcgtcgttctccgcagccgcctcgcgtgctttcgtctcgccgatctgccggctggcggcagcgacttgctggcgaagcggagcggcacgctgttcgagtgcggcgagctgtgcttccagtgccttgccttcgttctcgacttcccgcacagcggcgagctgcttggccgggaaattcatgtcgtgctcgcgcgtaccctgcgcaacgcgaaccgccacttggtttcggcgtacggccgtgttctcgcgaatctgcgcttgcagcgactccttctgcttgtcgtagatttcgagcagccgcgacgccgccgtgacctgacgttcgagttgttcggcgttggtcttcgacgtgtcggacaggctgcgctgcgagacctcgaacccacggttcaagtcgttgatcgtcttctgcgcgtcgaccttgaccttgttcgattccagctcgcccttcatctggaaatagatcgggatgatgatgcccgcagccgcgatggcgaggatcgcggcaatcggcccggagatgaggccgcccagcgcgacacccgcgcgacccgccgacgccgcagtgccggcaccgagcgcagtgttcagcgcgagcgtcgccgcacgcgccttcaggatttccgttgcgagcgacgtgaacaccattgcgatgcgcgcgccctgaatcgccagcatgatcgccagcagcgccttgaagttcttgatgaggaacgcaacggtgtccgccaccagcttgatgatttcgtcgttctccgcgagcaccttcagcagttcgccgccagcgtcggccgcagcgacgaacaccttcgtcaagttctccgcgaacttcttgccgtcgtcgctcttcaggtacttcgtcaggtcgacgaacaaacgacgcagcgcatcgccgaggccgccgtcgatgatttcgcgcttcagatcgccccatgcgttctgcatgcggttgaggtcgccgagcaaactattcgacgcagccttcgcctgcgggccgtagatgccacgggcagtctgtgcggcgagcagcacgaactctgctttcacttcgccgcccttttcgagcatgttgttcaactcttgcgtcgtgacgccgatggccttcgcgaacaggttgaacgcgccagtcatgcggtcgcccaactgaccacgcagctcttccgcttggatgaagccctttgagaagatttgctccaacgcacggaacgcgccggccgtttcgtcgccgctcaaccgcatcgcggtcgcagcttcggtgaacgcctcgaagatgtagcgcgtcgcctcggtgctcatgcctgcgtcgcgtgcagcgacggcgaagcgcgagtacgactcggacagcggcccgaacgcagcgcccagctcgtcggccttcttgcgtaggtagtcgtattcttccgccgccgcagtctggttgcccttgttcgcgatgagcagacgcgacatgacgcgctcgcgttccagtgccgcatccatcgcgctgttgacgaggttcagcgcaccgaacacgccgacatacgcggagaccagcgagagcacctgaccacgggtgcgctgatacagcgacagcgcggtacgctgaccgtcgttgaagagcttcaactgcgtgttggtcttcgcggtcgtctgctccaaccgcgtcatcgtctgcgcgacctgctcctgcccggtgcgcacgcgcgtcgcggcctgagcgagacgctgctcgatgccggtcaggttgttgagcgtgatgccggcggcagcggcgcgctgctgcacacggttgaacgcttcggtctggcgcgtcagttcgccgtgcgcctgcttcatctcgttctgcgcgcgctgcaacgacgccgccagttcgtcgttcggcttgtcggcgcgctcgaccgcctgcgcgtactggatcacttcttgccgcgcttcctcgaaccgctgttggctcgcgagcagcgcggtgttctggcggttcaattcgtcggcgagcccggcctgccccttcagcgcatcggcggcagcgcgcagccggcggctttgatcggccagcttgtcgatgccgtcagcggcttgcagggcgtccggcgtgagcgccttgaattcctcgtcgagctggtcgacggccttttccagccggtcgagcgtcgcgaccgcatccttggccgggtcgagaagcgcctgtacgcccgcagcagccccgctcgcggccgacccgctacccacggcagggacagccgccgcgcgggccgcagcgagcgcctgcgtgccgcccgcgcggaactgcgccccggcctgagccgccttttctttctcccgggccagcgtgcggtagacgttggccgtcagctcggccatcttctgctcgcggcgcatctggtcttcgcgctcgcgggcggcctgttccagcttcgccgccgagtcgcgggcttcctgcgcggcggcgcgctcagcctcgcgggcctgctgctgcgtcgtgcgcacttccttgacggcggcgtcgtagcgctccacgttgtcggtcgagcgcttatacagcgcgaccgagctattgagcgcctgattgacttcggcctgcgactgcgagaagcgcgtgacatccacgcccatgtcgcgcagcttcgtgccagtggtttccagacggcgctcgttgttgcgcagcgacgattccaacctcgtcacttcgctggcggccgtcttcaactgctgcgtgaattccttcgacggcttctccgtcttgtagaactcctgcgcgagcgtgttgaggttgtcgcgtgcgcggctcagctcgtcgcgcagactgcggacttgctgctcctgccgcgagtacgcatcgagcttggaagcgcggtcgttgagagacttcatgatcgcgagcaactgctgctgctcggacttcaggctctcgaacgaccgctccgccagtcggttcgcatcggctacttgctcttggttatctgcgatcttgctcagctcgtcgttgagctggttgatggttcgcgtgctgaggttcttcgcacgtacaatcagttcaacttcgttctgagcggccatcgcctatagtccttcgatgttttctttgaatgccgatgctgctttcttgctgagcgccgaggcgatagcactctgcgtcagcgtcatttcggttctgattctgttgttcacccgctcgcgtgcgatttccgattcgacgatcaaatacccgagcggatattcgccagcgttcgagtgaccttcagccgtcaggaaagagacggctgcgcggatgccgagccaccattcggcgaagcgctggcggcgagatttcggttgctgttctgcggcactacgccttttgcgcttcgcagtgccgcgaccacgtttcccacgaattctcggaagccggcctcgtcttggaacgtgagcttcgcgagcttattcaagcaatcgacctgcacgggcgcaggcaggtgcatcaccttgctccactgctccggctcgtgcgcggagtacgcgatgacgtgcgcgatgaaatcggggagctgcacgagaagccgctgaccgacttcgacgatgttgacgttcgcgaggtcttcggctttcttgacgccggcaccttcgacgatgttgaagatttcttcgatgttgctgagctgcgacaggatgagaccggcgatggcgttggcgctgaggccgtgcagcacgatgtcgtgctgctcatcgttcgcgccgacatacggaacggttgcagtgcggagttgcaggttggcaagggacatgcgtttttcctctggtggttatgagacaggccgccccgggggtacccgaggcggcctgtcaagttggtcttggctcgcttggtcttgactaagttggccttgaccgcgtttgacgatccccggttacgcggcggtcgggcgaccgtcgatgtactcggaagcgtagccgtcccgcttcaggatgtcgaatgcgaacgaaagctgctgccattcgtcgcccttcatcgcgaagtcgccatcggcccggagctgcacgtacggccagtagtagtcgcggcgcggcccggtcgggttgtacgagatgaagcgcagcgcgccttcgatggtcgtgccctcgcccaccacgatctgcgtccgggtcgacgcggcggtggcgtaggtcacgatcagcggctcggtcccgtcgatggccccgcccggcacgatgtacagccggcccagctcggggtcgacggtgtagtcggtcaggttgtcgaaggtcgtgccgaccggatcgctggtgacgctggtcagggtcacgttgcgatggccggtcgggttggcctgcgactcgccgagctggatgtaggtgcccggcttgacgcggttggccgggatgttctgcaccacgctggcggtcgccgactgcgcgaccacgttctgcgtaccgaggaaccacagcgcgatgttctcgtcgctgatttcgtcggcgatgaacgtgccgctgtcgttcttttcgagcacgatgctcttgtccttgacgcgaatgccacggtcactgttgaagtgatcgaggttttcgctctcggtggtgcggttcaactccggcgtgttgccgaggtagcgctcgccggtcttgttgaacgtgcccggtgcgaacttgtcgaaatgcagttcgccacggccaagggtgtaattctcgctgcccatttacggtctccttctgtcgatacaacggttaatcacgaatccagtacgggtctcccaccttttcgacgacttccagacgaatcctcatccagaaatacgccttttcggattgctcgtcgggagggcgaacaaccccgggctcgatggacagcgtgtttgcgagaccatcgaagaacccgctttggttgcgcggcaccagcagcttgccgagcgcttttttcacgtcccccatgagcagatgcgccgagtcttcttcctgctcgacatcgccgccttcggcccatccgttcaagaggtaaatctggtcgtacttgtgcttggtgccgacgacgccgccgatggtttccggcagacgatccgggttgaagttctccaacaccacgagcgccggcagcttcacttccttgccgaagttcttcttgccccggtacaccgaagcgaggtcgaagttgtagccattcgccgttgtgatttcggtcttcaggtgattgcagattgccttcagcagcagcagtcgtttcgtatcagccacggctcagtctcccgtagttgcgcaggaagctcgattcgagcacgtcgccgactggcccttgcacatcgaatcgaacatcgcgaaaaacttgatcgacagacgggccgtacagcaggtagagattgccgctgacctgcaccatctgcttcttgttcatgccgcccggcagcttcccgtcctgcaaccgcacggcgaggccgacgttcgcgttctccgggtcgtatacgccagtaccgcgacgcagcttcatcgggaacgcattcgggatgcgccgcgctgcgccagccgccgagaccttgacgcgcgcgtagccgcccttgccgagcttcgcgccggtcatgaactgcgcgagcgaagtcgggcgcatgcggccggcaatgacgccttcgaggtcgccgacgcgcgccttcttcgacacgcgcagtcgagcgttcgggttgtcggacgtgccgatgtagctcgccttgaatgcaacctgctcgcgaatgcggcggctgctctcggcctgaccgaacgtgactgcttcgttgatcgcgaacgcggaagcccggtctaccgtttccggtatcccggcaacgcgcttgcgcacgtcgtccaatccacggaagccaatctcgacggtcacggcgctacctcagtcacttcccacttgatgaaaatgtcgtcttccgcttcaccgcgcacatcgagcttgaacgcacgattgagctgcgggaagaacacgcggtcgccttcgtcagcgcccacgaaaatccgggtgtcgatgatgatgtagtccaccgcttcggtgacggtcgcgaagccttcgcggtccaagtcgccgaacgtgcgaaccttgtagtgcagccgagcggtgccgtcgacgacagcaccgcccgacttcgggcgaaattgggccggcagaccaaacgtgctatgcacggtttgccgagccttctgcttggtttcgagccagcccattccgttctcccttcagcgcgccgggcttacttgcccgcgccctgcttgccgccgctcttggccgtactgtcggtcgactcgaccttcggcgcggtgctcgggttcgacgacgcagccggagcctcgtcctcttccttcgcggcgtccttcgcggacttgatgtagccctgttccagcagcgagtcgtagagcttcttgtcgtcggtgccggccttggtgcccgcctgcacttcctgcaacgcggtgccgaggccgtcttcggcgtcgaaatcgcccttcagcgccacgcgggccacgaacttgtacttcgccatcttgatgctccttctttcggttggggagttgtgttgctacagcgaagcccggcgaaccgggcttgccgtgtgcgacgttgcttacgcgacgacgcgagcccgcagcgtgcagttcggacggctcgggatcatgagcggagccgactgcgacatgaggtagatcacggacgggtccgggttcttccacatcttcgggaagatgtcgagcgcctgaagatcggcgtccgcatccatgatcgcgccgaaggcacgcacgccgtcgaagccagcctcggcttcgagcagcacgtcgcgcgggtccatcatcggctgcatcgtgccggtctcgtcctcgtacacgtcgttgtagacgtagatgttgaacgagccgatctggcccttgaactccaccgactcgccgaggcccgggccggtttcggcttcggacttcgagccgcgccgggtttccagcagctccttgatgaccgggtgcttcttgaacgccttccacgcgaggcggcccatcgtgacgcgcgtgacgacgaaaccttcggcgtcatgcacacgagcggcccactcttcgaggtcgtcgtccgggtcgctgttcgtctggtccgtccacagcgcggtgccggtcaggatgacggtgtggttggcggcgcggccgaagtcgatggtgacggtcgggtaatcctcgcccgaaatcgtgacctgaccgtagagcgcagcctgcgcgcccagccactcccagcggcggtaaatctggttgcgctggtcgagctggtacgcggccaccacggcacgccagcgctggccgggcgtcatgtcgccggtcagtgcttcacccgcgaggcggcgcagcatgcggcccggggtaacggcgtccttcggcttgacgtaggccggacggaacgacttggtgtagaagccggaacgcttcaggactcgaccctgcacgttgggagccacgaacggagccatgcgccggccgagcttcagctcgtcgaacatgatttcttcggtcgtgaagttgatctgctccttgtacagacggttgaggaaatactgcacgggtgcccggctgtcgacgatcaccttgcgcagttccgcagtgctgaacaaatccatcgttgtctccttctatttcggtgtgtagttgcgaaacgtcttgctgttggtgatgccggcttagaccgggccggaaccggccggcgggttgccgtagagcttctgcgcgacgatgttggtgccgtcgaacgcggcggccttcagggcgtcggtgttggtcgcggcgttgaaggtcagcgcttccatgttgaacacgccaccgacgtagatcgcttccttcttgccggcggtcggggtcgccacgtcgtacgcgaggatcgcgatggcgttctcgctgccatcggtcgcggccggatcgtgcttggcgaacaggccggacgcggtgacgcggccgagaacctgaccgccgacgtacgcgacgccggtgacgagtgcgccctgcgtgctcacgatgtcggcttcgccggcatagagctggatgctgttcgtgtcggtacgagccacgtagccagcgatggggccgaagttggtcatttcgttactccttctgtgattgacggttagccggatttttcccgtctaggctggcgacggtgtgccgatattacttgacgacgcgaagcacgctcttgttgccggtggcagcggtgtacgcacccagcaggccgccatcgtcgttgccgcgcgcctgctcttcttcgtcgccgccgttgttggcgatgtccgcgccgccgccggagttcgacatggccgcgtccagtgcggacgacgcattggcctgcttcggcgaggccgacagcatcgacttcgcttcgtcgaccgacatcgtggtcttgaacgcgatgtggttcgccagcgcctcgcggcccttggcttcctcgcagccggtgatcgccgcgcaacgcgcctgcatggccgcgccggcatcgacctgctcgtcctgcttcttgcccgcgtcgacggtggtgtcggtggtcttgttttcgacctgctcgtcggccttcttctgctcgacggtggcatcggtcttcttcgtgtcgctcatggtgtcactcctatcgttggtggaagagccgaagacttcggcccggaaggtagcgatggcatcctgtggagacatcaccgcatcgaccaagccgattttgaccgcatcgtccgcctgatacacacgggcttgcgtgtcacgaaccgcttgttcggacatcccgcgattgatcgcaaccacggagatgaacttctgccacatgccgtcgagacgcgcctgcatgtctgcacgcacgttgtcgggaagcgggctgaaggggttgccgtcgaccttgtgttcgccggcatggatgagggagatggcgacgccgaacttttccagcgccttgctcatgtcgacgtgcatcgtcagcacgccgatgctgccgctgtcgcccgaaggcgtcgacaccatgcgctgcgcggaactgccgagcgagtacgcgcccgacatcgcgcctgcgttgacgacggacagcgacggcttcgtgtcgcggcccttgcggatgtgctcggccagctcgaagttgccgtacaccatgccgccgcccgagtggatgtcgaacacgatgcccgccacgtccgggtcagcctgcgcggcgtcgaactcgcggcgaatgtcgtcgtagccgcgcgtgccgtaccacgggtcgccgttgcgatgcacgagcgtgccgcgcatcggaatgaaggcgaggccgttgctgaagaggaacggcttggcgcgatcacgcgggaacgacacgtcgaacgcggattcgaccgctgcggtgatgccttcctgcgcctgcgcgcgctgctcggcgctcggcgggacggtcgcctgcgccatcgtcatgcacagcgttgcgaccttctcgacatcgcgagggtcgatcaacgccgggcggccgttgaatccctcgacaagcgccatgcgcattgcgagcagttcattcatcgtcgttctccgtgtcggtgtcggtatcggtgcccgtgtcatcggcgttgttcgacgcacggctgtcagtttctttctgcgtgcccggcttgctggtgctgagcgtgaagttgagcttcttcttctcgatgaggcccatctcgcgagcgcgctgagtgaacacttcgcggtagtccttgccgagcttgccgagttcttcttcgtaggtcgacaggcccgacgcgatgcgcagcacggccgcctgcgtttccttcagctcgtcgatctggccgcgcgacgcgccgatccagtcgcaacggcaatacgcctcgcggttgatgccctgatagaagtgcgcagcgcccttcggcagcggaagatcggtgtccggccgattgatttcctcttcgagccacagcatgtagatgagcgtggcgaagcggtcggtgacgagcttcttgcgcgtctgcatgtacttccacgtctcgatcatcgacgcgcgtgcggacgagtagttcgtcttcgagtagtccttcgagaactgctcgtacgacaggcccagcgcagcgcagatgtgccgcagcagcgagtcctcgaagccgctgccgacgccgcccggctggccggcgttttgcaggttgagcttcgtgcccgggaacaggtgcggaatgcgcacgccgtcgatggcgaggttgtcggcagaaccgacgtactcagccagcgcgcccatgtacttctgcaaccagcccatgtcgccggcaccgagctgcgagaacaccagctcgcgcggcagctccgactcgattgcagcagcgaaggtcgcattgacgacggcgttttgcagaacgatgtccttgtagaccttcgtcatgcgcatttctttcagcaccgcgaccatcttcgacacgccgcgcgtctggcccgggcgcagcacttcggcaatgtggatgatctgcggacggccccacggcttgaacgccggcacgcgcgtccacttcgagccgaagcggtcgtagtacgactccatcgggtgcgcgtcacgaatgtggtacgcctcggccgcaccgaacttgtcgatttcaacgccgcgccgcatgtaggcggtatcgctgttgtcgttcgggttgctcaggcggtcggggtcgatcatgttgatcgcggtcttgtacggacgaccggacttcgacaaccactccgcagcggcgagcgcttcgcccgacatgaaggactggccgagcgccatgcgcacgaggcccgtgagtccgttcttgcgcgaggcgtcgatccagttcatcggcgattcggcgtacagcatgaacttgcgttcggcgatgagctggaactcttcggcccacgcttcgctcaggcccaacgtctcccaatcggggcgcgcgttgaggatgtactggccgccgacgatggagtcggtgctcgtgtcgagcgcgccttggatgtagccgtcgttgcgaacgagttcgcgagtgcgcgcgtcgagccgaaccttgtccggcgagatttccatgtcggcgggcagcgacggcgcgctccacatcgcggtctgtcggttgagacgcgacgcgccttcgtacgcaccgccgaaggccgactctttgccggtgctgttgaatgcttcgtcgccctcgggggagcgaacgacagtgagtgctcgggccatgtcgttttaccctcagaagaacggacgaagggggccgcccgttactgcgacccccaatagggaattgatctgtgcctgcaaagtggctatgtatttggcgaggccggttgcgttggctcggctgtactcgacccgctccccgttctggtcgacgacgacggtcacgccgccgccgatcatgacgctatggtaggcggtttgtgcttccgccagccatgcttgcaactgctctagagtcgccatctctcatcccaaggatttcccgaacttggcgaaaccataatccgtgatggggcttgacgcaaaccgtttttcctgatccacacggcgcacaagagagttgttactccactccgcgtaccacgattcgggcgagtcccaatcgaatccttcgaccttcaagatgacgcacaggccgaggcagtagtagcccaagtcccacgcttcgttgcgtcgcttgcccgggttctgccagcggccacggtcatcgcggaactcgacagtgagttcggcatacacaacttcaggtgtccacttgttcgtgaagtggcgaccgccgagcgtcgtcttctcgtcgtagtcgaccatgccgagcagcatgtccttcagcacgttcgagttgaggaacagcaccgggatttcaccgcgagcaccggccgaacgatccttacgatccgagtcagggaagtcgacttcggcacgcggcgcaccgagcttcggctcgcccttgatgagcagcacgcgagcgccttcgcctttgtcgcgcatcgagcgccagtagttgtacgcgcgcgtcgtcgaacctgacttaccgccggagtcgatgccgaccatcttgatcgacatgaagccactgccatcttccaactcgtactcgcgctcgacgacctgctcggtgatgagttcccaatcttcctgcacggcgtacggcttgacccacagcgtatcgccggcatcgtcttgccgcttcgacttctggatgtcaaatcggtcgacgaggtacaggtcgaagttgacgccgttatcgctcgggccgacgccgaagacctgcacgacgaagcggctcttctgcacgtcgacggtcgcgagcaggaagcgcgcaccgtacggcaccttcttgtccgcccactggatcgccttcgattgcaggtcttccggcagacggttcgagtccttcgcgttgagcggccagaacgcttcgccttgatcggtgttgaccgtggccttcagcgccttcgtttcgcctgtgcgttcgagcgtctgctgcgcgagcaggtagcgctcgacaagcgtctgccacgtaatgaagcgcgccgccgggcctttcagccagaacgacgcgctgcgcgaacgcacaccgacgccgaggcggttgccgtcgcggtcgagacgctggccctcgcgcagccacacgccgcgacgattcatctcgtacttgtgcttcggctcgatcacgcatccgttcttcgggcacgccatcatcgtcgccgcagcagcctcgaacggatcgggattcttgaagtcccacttcagcagcgcgaacttcggctcgaaccactcgccgcagtgagggcactgccagtagaagcagcgacggtcgccttcgttgtacaggccaccgatgccatcggtcggcgggaacatatgcgagtccgggtgcggcaacttccacttcgggtctttcacgtcgaacgacggcgacgactcggccagcgtcatgccgaacgaaccgaacgtcgtcgtgcgcttgcgcgcgagcgggaacggcgggccgttcttctccacgtcctgtggcatgcggtcgtagtcggtcagcgcaacgcgcggcaccggcttgccggagagctgattgatcgtcggccagcccagcgtcagcatcatgccgttgcggtagaacttgtcgaagatgttgtcgttgtcgctgccgggccgcagcatcgcgcccagctccttgctgtcgcggtgcatcttgtcgatgcggcgatacgagaagtcgcgtgcagtgtcgcgcgctgtctggatgaggaagaagtcggccgggtcgcacttcgccgtgtacgcgatccagttgaggatgatttcggtcttgccgccctgcgccgggcctacgaagatgcacgactcgaactcgcggctcgtgagcacgtccatcggctcgacgaggtacggcgtttcgtcgttgtcccactcgccgacgaacgaaccctcgttgtcgaggtatcggtacttcgctgcggcctgagaaacggtcaagcgctccggcggaaccagaacgctatcggcaacgaacgtgaccagctcgccgaggtcgttgaagaaattaccgtcaagcatcgtcgtcttcctcttcgtcgagaccgatgtcgtcgagcttgatgtcggcgagctgttccttgtccttgatgccgacgtaaatctcgaagtcttcgacgaggcgcttgcgcagcatgtcgatggccttgtcggatacctcacgctcgatgatcgcgcgctgctccggcgtgaggccggtctgcgcttcgatgcggtcggccaacagccgaagcgactgtgtgagcgagcggaacacgccggtcagcacttcgagcacctgctgcgtgcgccacaagtcgcccgactgttccttgtacttcaacttgctgttctgcgcgttccagtattgcgcttgcagcggcgcgggcaggtcgccggggccgacttccgcgaggtacttggcgatgtcgacgatgggctccacgaggtagggcgcagcgtcgacgatgtggtacgtcggtgcgccgcgacggtcgccggtcggccgcagcgggcgcaacttctcagtgacggtgcggcggtcgaggcggaacaactgcgccaaacgcggcacagtcatgccgtcgaaaaactcttcttcgtagtcgatcttaggtgcggccattggctagttctctctgtacgtctgcgactcgtcgccgcatgggttctctcagggcgtcttgggtaatttctttcttgaccagctcgcgtgtcaaatcctcttcgatagtgcctactgctgtcaggtgcatcatgttgacgtggcttcgagtctggccgcgtcggtgcagtcgtttgcgcaactgcatgtagagttcgaggtcgggcgtgtggtcataccagatgaggttgttaccgcccttctggatgttcgtgccgtgaccgatgctcgcagggtgcgtctccgctatctcgatgtcgccggcattccatgcgtcgaggtcgcgcttcgtcttcagcgaacggatgccggggaactcgtcgcgcaggcggtcgcgagagtgctgccaagtgcgcgcgacgaggatcggcgagccatcgctgaactcgacgatttccttcaagcgctcgatcttcttgtcgtgtatgtcgacgaactctttcgtctcgctgtcggtgtagatgcgaccgcacgcgaactgcaacagctttccgtacagcgcgccttccgatagcgcacgcacggccgggtcttgctcttcgccccatttcagcacagacgtacgctcgaattcctgatagcgagccatcacatccggcggcaggatgatcggcacaggcgtagagcggagcggcggcagcttgacgtaatcctcttcgcgcagggtgtacacgatgtcgctgagcttcttcgtaatcgacgccatcgcgtgcgacttcgggatgaccttgcgacccatgaactcttgcttgaaccagcggaacaggaacttcttgtacgtcaggcccagcctctcgccgccgtcgatcatcgcaatctgcgaccagacttgatgcaggccgttcgggctcggcgtacccgtcagctcgatcacgtcgttcggttgcccccacgtcaggcgcacgccgtacttccaacgctttgacgacttgttgcggaacatgctcgattcgtcgaacacaaccgcgtcccacggcacggtatcgccgcgcttgaacaacgctgccagacgcccgagcttatgcaccgagatgccgtcgacctcgcacggccgctgcaactgcatgcgcatgtgctcggtgtcgccgtcgagttcctgatagtcgaggaagcgggtgtgctcccaattctttacttccgtcgaccacgtatccgagatgacgagcggcggaccaacgaccagcacgcggctccactcgcccgagaacaccttgtccgagacgtgcgtaagcacgacgacggtcttgccgaggcccatgtcgatccacaacgcgcaactgccgacccgttcgaggaacaggccggcagcgatttgaaactcgtcgaggtcggagcgcttcagtagttctttcattcaaaaatccactcggcgaattctttgtcgaagtagtcgatgacccacacgatcatccccttgcgtcgcagctccttgtgctcttcgagctgattgtccgtcgccttgccgccggggcgcttgaactcgatgaagaagacgaacccgttgcgaatgaacatgcggtcggggacgctgctgttgccgggcgacgagaacttgtatgccttccatccgtgccgcttcgcaacggcgcaccacttctgctccacatccttttcgacgcgatgtttgtcggtcggcaggatgtcgccgcgcggcggcttgccgttgattacgtttcgccagtcggttagccaagtcatttctgatagcactccactacgtcagccttcgcgcgaatcggaacatcttcgccccaccacttcggcttcttgaccatctgctcttcgagcgttgcggccgagatgtccgacagcttcttcttgaccagcgcaacgatttcgtcgtgtacgtgcatgcggacatcgagcccggacttccatgcgcgcagcagaccggcggccagcaactcgcgtgcgattgcctgcaccaagttctcgacgatcttgccgccgtgcgagtcgatgcgcgtccatttcttcttcgtgttgtagccttcgtacgtgaagcccttcttcgacttgtacttcggcttgccggtcttcttgtcgatgccgaccttgatctttttccagatcatcttcgggcgcaggtagtgcaggtagcgaccggacggcagacgcatgcgcaggaacggacccttcacgtccatgagaatcgggccgacgcgcaccggctccttcgtgttcatcaccttcgcgacggcgcgttccagctcgtaccacagctcgacgatttcggtgtattcctcgcggaagaacttcacgacggccgcagcatccttctgcgacatctcgatacccatgttctccgcgtagccccacaggccggtcttgatgacctcggggtactcgcccagctccataccgccgctgaggcggaagcctgcgccgagcacgccgggcttcgcgtgttgacgcatccacttctcgacctgctcgtagtcgaccttgtacatcttcgatgcgaacaccttgtacacgtcgaggttcttctgaaagacctcgatcaacttgtcgcagcccgacagccacgcgatgacgaccgactcaatcgaggccaagtcgcaggttgcgtactcatagccgggcggcgctttgatcgcagtgcggatgcacgatgcaatcgcgcccatcggcgacgacaccagcaggcgcacgaactcgatgtcttcgcgcatgatcgcgtcgcgcaccatgagcagtgccccttgttcttctagttcgcggagggggcggggcaaattttgcacctgcaccgcgcgcccggcccagcgcgccgtacgtcccgcgcctgcgaactgcatcgtgtagcacagcactccgtcgacttcgatgtcgagcatcttctgcaacttcgtcaccgacgagcgcgccgcttcggcgtgcaacgcgagcactgcattcgcgtcgtcggtcatgttccaatcccaatcctctcgggccttcttgatcgaggccgatttgaggttggtgaacgggtagccgcgctcgcgcagccacgggagcaactgcgtgccgctgccggggttgctcaggccggtgatgcggcccatctcgcccagcaggcgcttcttctccttcgcgatgacgcgcagcgcggtctcgacgaactccttgtcgaacggaatgccgcgttcgttgatgtgctggtcgatgtaccacaggttgcgctcgaagtcgctcatcgggaagagcgcgagcttgcgaccggcagcgcgctcggcgatcacgtcgcggcggccgtactcgacgaacgtcttccacttcgccgggtcagtcttctcggtgttgcgcgtgtactgcttggtcttggtcggcttgcgcggcccgcagaagaatttaacgagcgacttgccttccttcatcttcgcgttctcgccgaggcgcagcacgcccgagagttcgtcgaggttgccgggcagcgagagccagaatgcgtgcgccatcgagcaatagaactgctcgataggaatgtcgatgccgagaacgtgcagccaaatcgcgcgctcgaactgagcgttgtgcgcgcacttctgcacgttcgggtctttgagagcgcggcgcagacgcttcggcatcggctccgtcgcggggaaccagacttccggttcttcgtcgttgaatgcgtaccacaggaacagcacttcggtcgacttgtcgcgcgcgtatcgcgccaagccgtgcttcttcaggtcgcacttgctgaaggtctcgaagtcgtgatgcagcttgtccataccgtatccctgaaaaacagccgcccggggagtgcccgggcgaccgtaggtaccgcttaccgatgcccgattttagatgccgaggtcgtcgtcatcttcgtcgtcatcctcgtcgcgcgagcgacggctcttgctgctggtcttgctcttcgacgagcgactgcggcgcgagctgctgtcgtcgtcatcgtcgtcgccgagcccgtcatcgtcatcgtcctcgtcgcgagaacgacccttcgacttgctcttggacttgctgcggctggtgctgctgtcatcgtcctcgaagtcatcttcgagttcgtccagaacctcgtcgacatccgggcgagcattgcccgcgaggttgtcgtcgtggtcgacgaactgcacgatgtcgaagccggcattgatgcgcttgccgtacttgttcttcttcttcatggacttgccgttctgagcccacgggcggatcaccacgttggcccacgcgccgctgtacagcagctcgtcgtcttcctcggtaggctgacgatcacggtcgacgaggatcggcttccgggtctcgcgaaccgtcaccgtccagcagccgtggtggtcttcgacatccgactcgtcaccatcacgcaggaacttgcggtcggccgccagcttcgggttgccgtactcttcctcgcacatctcggagatgaggcgggagagcttctgcgcgacgggcttgtgcgtcgccttcgggagcagcagggtgacgcgatacgacttcttcttgttgccgttgtcgtcttcatgctcgtcgggctcgaacaagtacgggaagctcaggcgcacgttcttcagcagaaaacgcccattgcccttgtcgaccagatcaccaactttcttcttcgccatttcgatttctccttcgtcattcgacgttcgtagttcgctttcgcgcattcgtacaacaggatgctcagtcgtcgagcaattcgagcgactgaacagtcaggtctttccgcttgtcgtctgcggagaccagacacggtttgccgggcttcgacttgatgaagtcctgcaatttcttcttcgcctcgccgcgcaccagcttttcggcctgcgcaggcgacacgaactcgggtttggagtacagcttcgactcaggcacaccggcttccagcagcagcagctccgcgtcgacctcactgacgaagtagcgcgagctgcggcctgccacggtcttcaggcccggcacgaaatcgccgtccgcgaccttcttgtgcaggtagtcttcgactgcacgcatgcggttctcgtacatgcccttgcgcagccacagcgccgcgatttcctcgtcgctcatgagcatgaggtcaggctcgacgaattcgtcgtcgtcatcgagcagcatgatgcgctcgtggtacaggaagtcgtggttcgcgcggcacttgaagttgaccttgcagaagcggcacgccttctcgctcgggccgaacggcgggttcggcttcagcgcgagcgcgaagcgctccttgatcttctcgccgatagcgagcagttccgccttgctggtgatccacacgtcgaagtgatcgagacgcggttgcgcaatgcggatgattacttcgtcgaagtcgtacagccagtcgtactcgttgataaagccgagcgcgtacatcacgagctgcttgttctgcggcgcatcgacctgcacgcggccgtacttcaagtcggtgatgatgagcttcttgtgcgacgctgcggcgtgatcgcacgtaccgaattgatcggggatcgggcaccacggggagatgttgacgcgcgtctcgacgtagtggtcgcccggcagacccatgatgcggtcgaggtatgccccgacaccctgcaccatctcgtcgtcgacggtgatcgcgaagcctttcgaggaatgctgctcttcgtcgtagtcggcgtcgaggtcgccgctgtcgaacgtcattcctagaaactcttccggctcgcggcgcgcgcgtgcgcaaatttccgcgatgtgatgcgccacggtgccttcggccgcttcgtaaatctcgcggtcgggctcgttctcgttgagcagcaggcttgccgggcaatcgtaaatgcgatgcgccgacgatggtgcgaagcgagcatgagaaccgggcatgtatttctctccgaaagaaacgcccgagcgaacccgggcgtttcgtgtgacgtgcaggccgaattacttcttcgagccggcgcggttgatttccttcagcgcttcggcgtacttcttcggcgggatgttcagcacgttggactcgtcgagcttcgcgagcacttcgcggcacttgtcgatgcccttgctggccttcagcgccttgaaggcgttgacgacatcttcctgcgtcacttcttcgtcttcgtcgccgaggccgaggtcgtcgtcgccgtcgtcaccgaggccgtcgtcttcctcttcttcctcttcctcgtccttcggcttggacttgcccttggccgccggcttggtttcggtcttggccttgttggtgctgccggcgggacgaccgcgacccttcttcggtgcggcttcttcctcgccgtcatcgtcgccggcatcgctggtgttcgcggcaccgccgaaggcggcgacgagcacgggtgcgagagcggcggcaatggcttcggcgagcgacttcgcgttgagcttcgacatcggttgtatctcctagctaggttggttttgggagtgacgggtggattgcaattcctgcccggcgagcgcactatgcgcccgtcccgatgctaagtcaataggcatgctcatcgacttagcagaccccttaaatcccaatgtctgcgaggaattcatgcgccgagaccctacccttgattcactggatagcgcagatgcgcgagtgcgctatctgctccggcgcatcgccctcatgctcgacccgccgtacggtcgactcaacgcaatctgcgagaagtacaactggcacgagaccactgtctcgcgttggcagcgcctcggcggtgtgccgcgcgacaaggccacgatcttgcacaaggatttcaaccgcaagatcggcttcaacctcgaagaccttgttagcgacgacatcgcggagtgacctatggctgctggacgaccgatcaccagcgtgctccgtaagtacggcgctcaattgctggaaaacgggtactccatcttgccaatcccggcaggaaggaaaggcccgattgaaccgcagtggcagaaaatccaagccaccgaaaagctcgtgcgcaagtgggcgagcggcaactacaagcagggcaacatcggcttccacacgaagcacacgcctgcggtcgacatcgacatcaccgatgacgacatggcggcgctcatggccgagcacaccgaggaaatcatcggcaagacgatgacgcgcgtcggccgtgcgccgaagacgttgctcgtgtatcgcactgacattccgttctcgaagcggaagatcacgttcctcgacaccgagggccacgagcagtccatcgaagtgctcgcagacggccagcagttcgtcggcatcggcatccaccccgacaccaagaagccgtacaagtggacttcgggcaaggaactcaacccgctgagcgtgccggccgacatgctgccggaaatcacgaccgagcacatcgacgaactcttctcggtgttcaagctcgaagcgcagcgtcgcggatggacgttgaagaagcacaacgcaccgagcgagtcgcgcagcagcgacgacgagaacgacaacgcactgctggaatacaagcgcccgctggaaaacctgaccgaagaccagctccgcgaagtgctgcagtgggttcccggtgccgacgactacgagcagtggttgaaggtcggcatggcgctgcatcaccaattcgacggcaacgaagaaggcttgacgttgtggcacgagtggtcggagccagcgcacaactacgaccccgacgaattggagttcaagtggaactcgttccacgacgacatgggccgcaacctgacgacggccgcctcgcttatcaagatggcgaaggagcatcggcaggagcactcgcaggaacagttcgagaagatcaagcgcaaggtcgccgagacgacgagcgagatggagttgcttggcccgcttgctgcgaagtggggccgcatgctcgaaagcgacttccaagtcgagctgttggccggcgcgattaaggagcgcgtcgcggagctggggaagaaggttcccatcgcgatgatccgcaaggcgatcaacgagggctaccgcaactccgacttcaactacaaggaactgccgcattggtgcaacgacgtggtgtacgtcgacgccgaggaagagttctactacatggacaaccgcctcgcgctgagcgagcgtgcgttcaatgcgcgcaacaaccgtttcctgctgtcgaagaaagaccgctcgaacatggaagccgtgcctgagcaacaggccgccgcactcgcgctcaacgtgtaccaagttccggtcgtcagcggctacgtctacctgcccggcgcagaccgcatcgtcgagtgggacggccagaagcacgcgaacaagttcaacccggaagacatcgtgccggtgcccgacaagctgagcagcaaggcccggcgcgcagtcgaagccgtgaagcgtcacttcgagatttcgtaccccatcgagcgcgagcgcgaaatcctgctctcgtggctggcttacacgatcaagcgcatggacaagaaaatccgttgggcggttgtgatgcagggcgtggacggcgcaggcaagggcttcgtcggtgaaatgctcatggcgatcatgtcgcgcaacaacgtcgagaccgtcaacgctcaggcgctcgaagagaagtacacgtcgttcttcgagtcgcgcaaggtcgtggtgctcgaagaggcacgcatccacggtacgtcgcgctacgcggtgatggacaagctgaagcccttcatcacgaacgacgtggtttcgattcgccgcatgcaccgcgactcgtacaacgtgccgaacgtgacctcgacgatcatcttgaccaaccacagcgatgcgctgccggtgtacgacgccgaccgccgctacttcgtcatctcgacccacttccagacgaagcagatgatcgagaagttccgcgcgcgcaacccggatcactacgacgacatcttcaacgcaatcgcctaccacccgggcgcgatccgcgagtggctggaagactacccgctgcatcctgagttcgacccggacggccatgcgcccatgaccgacgcgaaggcgcgcatgatcgacctcgcgcgcggcgacgacgaagacgaaatcgaagagatgatcgcggagtcgcgcgacccggaagtgacgagcctgctgctcaacgtcgggaagctgcgtgacctcgcgatggacaacagtgtcggcgtgccgtacgggccgaagttgtcgaacttcctgacctcgaagggcttcgtgtacgtgggccgcgcgcgcggtgcgaatggaaagcaggcgcggtattggtcacgctcgccggatgtcgtcgtgcggccgaaccttcagcagtggatcgacgactacatcgaagtaacatcgctgaaggtgtgaacgaacaagcccgggcaaccgggctttttcacgtctgcgagcgtatgatcgaacacgctcaatcccgagcacaggagaaacgacatgacgactaccgtgaagttcacgcacgtcaacggcaacaaggcggtcgagttggtcgacggaaagggcgtggtgcatgcagtgctcgatgcgcccggccgctcggtcgaaatcacgatgcacggtgacttgcaggtcacagcgcgcgagaccggcgaattcttcggcgcgtcgaagccgcagggcatggtgccgaatgcgaccgtcgacgagaacaacaccgacgcgaaccgctacgagagcggcgaccttccgcccggtgccggcgacaacggctcgaacgtggaagacgagcgcgtcgaggatcgcaacccacgcaactcgatttaattcctcggaatttccgcaacaccggccccgggctcatcccccggggctttttattgcccgcgtggcggaaattcgactcatcccagcttgacatagtgcccgaccgaaacggatgcgaaaaattcggatttctaggtactgtcacatacggaaaaaattcctaccgtatggacggaaattcggaaaaaaggcaattcttgtgacagtacccgattttccatgctctccgaggcgcgaatcggtcactgtcacaaggtactgtcacaaattcaagtcattgatctacctactcttttccctattttgtgacagtagtgacagtagtgacagtaccttctctcatacgcgagaaatttttcttggaaggcagaaaaacttttctccggtaaaggaaaagaagtcactgtcacagtgtcactgagggggtctgacgcagtaaattcgcgcgcaaaaacgccttgttttcagccttttcaacggggggccgaaccatgtgacactactttgtgacactgaaaggtactgtcacaagcgaattaaatgcgcgcggggcggatattcggcaatttccgggcggcccgggggtcgattggagacggaaacgcaaaaattccgaaaaatgcgcgagcaccgaggtcagcgccccc

SEQ ID NO: 17 - DNA, 55589 bp, Unknown
  Bacteriophage Xfas107
ggctgggcctgacgtacaagaagttcctgttccgctggttcaagcaagagttcatgggtcgcaaggtcatcccgaagtcgcacgcgatggcgtcgattacgaagaagctcagcgacatcgtgtacaccctgcgcgaagaggattacgtcaagctgccgccgctccgctctacgcctgtgccgatcatcctgccgccggatgtgatggctcgctatcaggaattcgagcgtacgtctgtgctgaaatggggcgaagagcaagacccggccgtgcgtgcgctatcggaaggcgcgctgtacggaaagctgttgcagttcgcgtgcggtcgcatctacaccgacagcgagacgaaagagttcgtcgacatacacgacaagaagatcgagcgcttgaaggaaatcgtcgagttcagcgatggctcgccgatcctcgtcgcgcgcacttggcagcactctcgcgaccgcctgcgcgacgagttccccggcatccgttcgctgaagacgaagcgcgacctcgacgcatggaatgccggcgacatcgagatagcggagacgcaccctgcgagcatcggtcacggcacgaacatccagaagggcggtaacaacctcatctggtatgaccacacgcccgacctcgaactctacatgcagttgcgcaaacgactgcaccgacgcggccagactcgaagccacgtcaacatgatgcacctgacagcagtaggcactatcgaagaggatttgacacgcgagctggtcaagaaagaaattacccaagacgccctgagagaacccatgcggcgacgagtcgcagacgtacagagagaactagccaatggccgcacctaagatcgactacgaagaagagtttttcgacggcatgactgtgccgcgtttggcgcagttgttccgcctcgaccgccgcaccgtcactgagaagttgcgcccgctgcggccgaccggcgaccgtcgcggcgcaccgacgtaccacatcgtcgacgctgcgccctacctcgtggagcccatcgtcgacatcgccaagtacctcgcggaagtcggccccggcgacctgcccgcgccgctgcaagcgcaatactggaacgcgcagaacagcaagttgaagtacaaggaacagtcgggcgacttgtggcgcacgcagcaggtgctcgaagtgctgaccggcgtgttccgctcgctcacacagtcgcttcggctgttggccgaccgcatcgaagcgcagaccggcctcacgccggagcagcgcgcgatcatcgagcgtgaggtatccgacaaggccatcgacatgctgcgcaagcgcctcgtcgaagacttcgagatttacgtcggcatcaaggacaaggaacagctcgccgacatcaagctcgacgacatcggtctcgacgaagaggaagacgacgatgcttgacggtaatttcttcaacgacctcggcgagctggtcacgttcgttgccgatagcgttctggttccgccggagcgcttgaccgtttctcaggccgcagcgaagtaccgatacctcgacaacgagggttcgttcgtcggcgagtgggacaacgacgaaacgccgtacctcgtcgagccgatggacgtgctcacgagccgcgagttcgagtcgtgcatcttcgtaggcccggcgcagggcggcaagaccgaaatcatcctcaactggatcgcgtacacggcgaagtgcgacccggccgacttcttcctcatccagacagcgcgcgacactgcacgcgacttctcgtatcgccgcatcgacaagatgcaccgcgacagcaaggagctgggcgcgatgctgcggcccggcagcgacaacgacaacatcttcgacaagttctaccgcaacggcatgatgctgacgctgggctggccgacgatcaatcagctctccggcaagccggtgccgcgcgttgcgctgaccgactacgaccgcatgccacaggacgtggagaagaacggcccgccgttcccgctcgcgcgcaagcgcacgacgacgttcggttcgttcggcatgacgctggccgagtcgtcgccgtcgttcgacgtgaaagacccgaagtggaagttgccgcacccggactcgcatatgttcccgccgaccgatggcatcggtggcctgtacaacgaaggcgaccgtcgctgcttctactggcagtgccctcactgcggcgagtggttcgagccgaagttcgcgctgctgaagtgggacttcaagaatcccgatccgttcgaggctgctgcggcgacgatgatggcgtgcccgaagaacggatgcgtgatcgagccgaagcacaagtacgagatgaatcgtcgcggcgtgtggctgcgcgagggccagcgtctcgaccgcgacggcaaccgcctcggcgtcggtgtgcgttcgcgcagcgcgtcgttctggctgaaaggcccggcggcgcgcttcattacgtggcagacgcttgtcgagcgctacctgctcgcgcagcagacgctcgaacgcacaggcgaaacgaaggcgctgaaggccacggtcaacaccgatcaaggcgaagcgttctggccgctcaacgcgaaggactcgaaccgtctgccggaagacctgcaatcgaaggcgatccagtgggcggacaagaaggtgccgtacggtgcgcgcttcctgctcgcgaccgtcgacgtgcagaagagccgcttcgtcgtgcaggtcttcggcgtcggcccgagcgataacggcgtcaacttcgacctgtacctcgtcgaccgatttgacatccagaagtcgaagcggcaagacgatgccggcgatacgctgtgggtcaagccgtacgccgtgcaggaagattgggaactcatcaccgagcaggtcgtcgagcgcgagtacgagttggaagatggcagtggcttcatgtcgatcaagatggtcggcatcgactccggcggtaagtcaggttcgacgacgcgcgcgtacaactactggcgctcgatgcgcgacaaaggcgaaggcgctcgcgtgctgctcatcaagggcgagccgaagctcggtgcgccgcgtgccgaagtcgacttccctgactcggatcgtaaggatcgttcggccggtgctcgcggtgaaatcccggtgctgttcctcaactcgaacgtgctgaaggacatgctgctcggcatggtcgactacgacgagaagacgacgctcggcggtcgccacttcacgaacaagtggacacctgaagttgtgtatgccgaactcactgtcgagttccgcgatgaccgtggccgctggcagaacccgggcaagcgacgcaacgaagcgtgggacttgggctactactgcctcggcctgtgcgtcatcttgaaggtcgaaggattcgattgggactcgcccgaatcgtggtacgcggagtggagtaacaactctcttgtgcgccgtgtggatcaggaaaaacggtttgcgtcaagccccatcacggattatggtttcgccaagttcgggaaatccttgggatgagagatggcgactctagagcagttgcaagcatggctggcggaagcacaaaccgcctaccatagcgtcatgatcggcggcggcgtgaccgtcgtcgtcgaccagaacggggagcgggtcgagtacagccgagccaacgcaaccggcctcgccaaatacatagccactttgcaggcacagatcaattccctattgggggtcgcagtaacgggcggcccccttcgtccgttcttctgagggtaaaacgacatggcccgagcactcactgtcgttcgctcccccgagggcgacgaagcattcaacagcaccggcaaagagtcggccttcggcggtgcgtacgaaggcgcgtcgcgtctcaaccgacagaccgcgatgtggagcgcgccgtcgctgcccgccgacatggaaatctcgccggacaaggttcggctcgacgcgcgcactcgcgaactcgttcgcaacgacggctacatccaaggcgcgctcgacacgagcaccgactccatcgtcggcggccagtacatcctcaacgcgcgccccgattgggagacgttgggcctgagcgaagcgtgggccgaagagttccagctcatcgccgaacgcaagttcatgctgtacgccgaatcgccgatgaactggatcgacgcctcgcgcaagaacggactcacgggcctcgtgcgcatggcgctcggccagtccttcatgtcgggcgaagcgctcgccgctgcggagtggttgtcgaagtccggtcgtccgtacaagaccgcgatcaacatgatcgaccccgaccgcctgagcaacccgaacgacaacagcgataccgcctacatgcggcgcggcgttgaaatcgacaagttcggtgcggccgaggcgtaccacattcgtgacgcgcacccgatggagtcgtactacgaccgcttcggctcgaagtggacgcgcgtgccggcgttcaagccgtggggccgtccgcagatcatccacattgccgaagtgctgcgcccgggccagacgcgcggcgtgtcgaagatggtcgcggtgctgaaagaaatgcgcatgacgaaggtctacaaggacatcgttctgcaaaacgccgtcgtcaatgcgaccttcgctgctgcaatcgagtcggagctgccgcgcgagctggtgttctcgcagctcggtgccggcgacatgggctggttgcagaagtacatgggcgcgctggctgagtacgtcggttctgccgacaacctcgccatcgacggcgtgcgcattccgcacctgttcccgggcacgaagctcaacctgcaaaacgccggccagccgggcggcgtcggcagcggcttcgaggactcgctgctgcggcacatctgcgctgcgctgggcctgtcgtacgagcagttctcgaaggactactcgaagacgaactactcgtccgcacgcgcgtcgatgatcgagacgtggaagtacatgcagacgcgcaagaagctcgtcaccgaccgcttcgccacgctcatctacatgctgtggctcgaagaggaaatcaatcggccggacaccgatcttccgctgccgaagggcgctgcgcacttctatcagggcatcaaccgcgaggcgtattgccgttgcgactggatcggcgcgtcgcgcggccagatcgacgagctgaaggaaacgcaggcggccgtgctgcgcatcgcgtcgggcctgtcgacctacgaagaagaactcggcaagctcggcaaggactaccgcgaagtgttcactcagcgcgctcgcgagatgggcctcatcgagaagaagaagctcaacttcacgctcagcaccagcaagccgggcacgcagaaagaaactgacagccgtgcgtcgaacaacgccgatgacacgggcaccgataccgacaccgacacggagaacgacgatgaatgaactgctcgcaatgcgcatggcgcttgtcgagggattcaacggccgcccggcgttgatcgaccctcgcgatgtcgagaaggtcgcaacgctgtgcatgacgatggcgcaggcgaccgtcccgccgagcgccgagcagcgcgcgcaggcgcaggaaggcatcaccgcagcggtcgaatccgcgttcgacgtgtcgttcccgcgtgatcgcgccaagccgttcctcttcagcaacggcctcgccttcattccgatgcgcggcacgctcgtgcatcgcaacggcgacccgtggtacggcacgcgcggctacgacgacattcgccgcgagttcgacgccgcgcaggctgacccggacgtggcgggcatcgtgttcgacatccactcgggcggcggcatggtgtacggcaacttcgagctggccgagcacatccgcaagggccgcgacacgaagccgtcgctgtccgtcgtcaacgcaggcgcgatgtcgggcgcgtactcgctcggcagttccgcgcagcgcatggtgtcgacgccttcgggcgacagcggcagcatcggcgtgctgacgatgcacgtcgacatgagcaaggcgctggaaaagttcggcgtcgccatctccctcatccatgccggcgaacacaaggtcgacggcaaccccttcagcccgcttcccgacaacgtgcgtgcagacatgcaggcgcgtctcgacggcatgtggcagaagttcatctccgtggttgcgatcaatcgcgggatgtccgaacaagcggttcgtgacacgcaagcccgtgtgtatcaggcggacgatgcggtcaaaatcggcttggtcgatgcggtgatgtctccacaggatgccatcgctaccttccgggccgaagtcttcggctcttccaccaacgataggagtgacaccatgagcgacacgaagaagaccgatgccaccgtcgagcagaagaaggccgacgagcaggtcgaaaacaagaccaccgacaccaccgtcgacgcgggcaagaagcaggacgagcaggtcgatgccggcgcggccatgcaggcgcgttgcgcggcgatcaccggctgcgaggaagccaagggccgcgaggcgctggcgaaccacatcgcgttcaagaccacgatgtcggtcgacgaagcgaagtcgatgctgtcggcctcgccgaagcaggccaatgcgtcgtccgcactggacgcggccatgtcgaactccggcggcggcgcggacatcgccaacaacggcggcgacgaagaagagcaggcgcgcggcaacgacgatggcggcctgctgggtgcgtacaccgctgccaccggcaacaagagcgtgcttcgcgtcgtcaagtaatatcggcacaccgtcgccagcctagacgggaaaaatccggctaaccgtcaatcacagaaggagtaacgaaatgaccaacttcggccccatcgctggctacgtggctcgtaccgacacgaacagcatccagctctatgccggcgaagccgacatcgtgagcacgcagggcgcactcgtcaccggcgtcgcgtacgtcggcggtcaggttctcggccgcgtcaccgcgtccggcctgttcgccaagcacgatccggccgcgaccgatggcagcgagaacgccatcgcgatcctcgcgtacgacgtggcgaccccgaccgccggcaagaaggaagcgatctacgtcggtggcgtgttcaacatggaagcgctgaccttcaacgccgcgaccaacaccgacgccctgaaggccgccgcgttcgacggcaccaacatcgtcgcgcagaagctctacggcaacccgccggccggttccggcccggtctaagccggcatcaccaacagcaagacgtttcgcaactacacaccgaaatagaaggagacaacgatggatttgttcagcactgcggaactgcgcaaggtgatcgtcgacagccgggcacccgtgcagtatttcctcaaccgtctgtacaaggagcagatcaacttcacgaccgaagaaatcatgttcgacgagctgaagctcggccggcgcatggctccgttcgtggctcccaacgtgcagggtcgagtcctgaagcgttccggcttctacaccaagtcgttccgtccggcctacgtcaagccgaaggacgccgttaccccgggccgcatgctgcgccgcctcgcgggtgaagcactgaccggcgacatgacgcccggccagcgctggcgtgccgtggtggccgcgtaccagctcgaccagcgcaaccagatttaccgccgctgggagtggctgggcgcgcaggctgcgctctacggtcaggtcacgatttcgggcgaggattacccgaccgtcaccatcgacttcggccgcgccgccaaccacaccgtcatcctgaccggcaccgcgctgtggacggaccagacgaacagcgacccggacgacgacctcgaagagtgggccgctcgtgtgcatgacgccgaaggtttcgtcgtcacgcgcgtcacgatgggccgcctcgcgtggaaggcgttcaagaagcacccggtcatcaaggagctgctggaaacccggcgcggctcgaagtccgaagccgaaaccggcccgggcctcggcgagtcggtggagttcaagggccagatcggctcgttcaacatctacgtctacaacgacgtgtacgaggacgagaccggcacgatgcagccgatgatggacccgcgcgacgtgctgctcgaagccgaggctggcttcgacggcgtgcgtgccttcggcgcgatcatggatgcggacgccgatcttcaggcgctcgacatcttcccgaagatgtggaagaacccggacccgtccgtgatctacctcatgtcgcagtcggctccgctcatgatcccgagccgtccgaactgcacgctgcgggctcgcgtcgtcgcgtaagcaacgtcgcacacggcaagcccggttcgccgggcttcgctgtagcaacacaactccccaaccgaaagaaggagcatcaagatggcgaagtacaagttcgtggcccgcgtggcgctgaagggcgatttcgacgccgaagacggcctcggcaccgcgttgcaggaagtgcaggcgggcaccaaggccggcaccgacgacaagaagctctacgactcgctgctggaacagggctacatcaagtccgcgaaggacgccgcgaaggaagaggacgaggctccggctgcgtcgtcgaacccgagcaccgcgccgaaggtcgagtcgaccgacagtacggccaagagcggcggcaagcagggcgcgggcaagtaagcccggcgcgctgaagggagaacggaatgggctggctcgaaaccaagcagaaggctcggcaaaccgtgcatagcacgtttggtctgccggcccaatttcgcccgaagtcgggcggtgctgtcgtcgacggcaccgctcggctgcactacaaggttcgcacgttcggcgacttggaccgcgaaggcttcgcgaccgtcaccgaagcggtggactacatcatcatcgacacccggattttcgtgggcgctgacgaaggcgaccgcgtgttcttcccgcagctcaatcgtgcgttcaagctcgatgtgcgcggtgaagcggaagacgacattttcatcaagtgggaagtgactgaggtagcgccgtgaccgtcgagattggcttccgtggattggacgacgtgcgcaagcgcgttgccgggataccggaaacggtagaccgggcttccgcgttcgcgatcaacgaagcagtcacgttcggtcaggccgagagcagccgccgcattcgcgagcaggttgcattcaaggcgagctacatcggcacgtccgacaacccgaacgctcgactgcgcgtgtcgaagaaggcgcgcgtcggcgacctcgaaggcgtcattgccggccgcatgcgcccgacttcgctcgcgcagttcatgaccggcgcgaagctcggcaagggcggctacgcgcgcgtcaaggtctcggcggctggcgcagcgcggcgcatcccgaatgcgttcccgatgaagctgcgtcgcggtactggcgtatacgacccggagaacgcgaacgtcggcctcgccgtgcggttgcaggacgggaagctgccgggcggcatgaacaagaagcagatggtgcaggtcagcggcaatctctacctgctgtacggcccgtctgtcgatcaagtttttcgcgatgttcgattcgatgtgcaagggccagtcggcgacgtgctcgaatcgagcttcctgcgcaactacgggagactgagccgtggctgatacgaaacgactgctgctgctgaaggcaatctgcaatcacctgaagaccgaaatcacaacggcgaatggctacaacttcgacctcgcttcggtgtaccggggcaagaagaacttcggcaaggaagtgaagctgccggcgctcgtggtgttggagaacttcaacccggatcgtctgccggaaaccatcggcggcgtcgtcggcaccaagcacaagtacgaccagatttacctcttgaacggatgggccgaaggcggcgatgtcgagcaggaagaagactcggcgcatctgctcatgggggacgtgaaaaaagcgctcggcaagctgctggtgccgcgcaaccaaagcgggttcttcgatggtctcgcaaacacgctgtccatcgagcccggggttgttcgccctcccgacgagcaatccgaaaaggcgtatttctggatgaggattcgtctggaagtcgtcgaaaaggtgggagacccgtactggattcgtgattaaccgttgtatcgacagaaggagaccgtaaatgggcagcgagaattacacccttggccgtggcgaactgcatttcgacaagttcgcaccgggcacgttcaacaagaccggcgagcgctacctcggcaacacgccggagttgaaccgcaccaccgagagcgaaaacctcgatcacttcaacagtgaccgtggcattcgcgtcaaggacaagagcatcgtgctcgaaaagaacgacagcggcacgttcatcgccgacgaaatcagcgacgagaacatcgcgctgtggttcctcggtacgcagaacgtggtcgcgcagtcggcgaccgccagcgtggtgcagaacatcccggccaaccgcgtcaagccgggcacctacatccagctcggcgagtcgcaggccaacccgaccggccatcgcaacgtgaccctgaccagcgtcaccagcgatccggtcggcacgaccttcgacaacctgaccgactacaccgtcgaccccgagctgggccggctgtacatcgtgccgggcggggccatcgacgggaccgagccgctgatcgtgacctacgccaccgccgcgtcgacccggacgcagatcgtggtgggcgagggcacgaccatcgaaggcgcgctgcgcttcatctcgtacaacccgaccgggccgcgccgcgactactactggccgtacgtgcagctccgggccgatggcgacttcgcgatgaagggcgacgaatggcagcagctttcgttcgcattcgacatcctgaagcgggacggctacgcttccgagtacatcgacggtcgcccgaccgccgcgtaaccggggatcgtcaaacgcggtcaaggccaacttagtcaagaccaagcgagccaagaccaacttgacaggccgcctcgggtacccccggggcggcctgtctcataaccaccagaggaaaaacgcatgtcccttgccaacctgcaactccgcactgcaaccgttccgtatgtcggcgcgaacgatgagcagcacgacatcgtgctgcacggcctcagcgccaacgccatcgccggtctcatcctgtcgcagctcagcaacatcgaagaaatcttcaacatcgtcgaaggtgccggcgtcaagaaagccgaagacctcgcgaacgtcaacatcgtcgaagtcggtcagcggcttctcgtgcagctccccgatttcatcgcgcacgtcatcgcgtactccgcgcacgagccggagcagtggagcaaggtgatgcacctgcctgcgcccgtgcaggtcgattgcttgaataagctcgcgaagctcacgttccaagacgaggccggcttccgagaattcgtgggaaacgtggtcgcggcactgcgaagcgcaaaaggcgtagtgccgcagaacagcaaccgaaatctcgccgccagcgcttcgccgaatggtggctcggcatccgcgcagccgtctctttcctgacggctgaaggtcactcgaacgctggcgaatatccgctcgggtatttgatcgtcgaatcggaaatcgcacgcgagcgggtgaacaacagaatcagaaccgaaatgacgctgacgcagagtgctatcgcctcggcgctcagcaagaaagcagcatcggcattcaaagaaaacatcgaaggactataggcgatggccgctcagaacgaagttgaactgattgtacgtgcgaagaacctcagcacgcgaaccatcaaccagctcaacgacgagctgagcaagatcgcagataaccaagagcaagtagccgatgcgaaccgactggcggagcggtcgttcgagagcctgaagtccgagcagcagcagttgctcgcgatcatgaagtctctcaacgaccgcgcttccaagctcgatgcgtactcgcggcaggagcagcaagtccgcagtctgcgcgacgagctgagccgcgcacgcgacaacctcaacacgctcgcgcaggagttctacaagacggagaagccgtcgaaggaattcacgcagcagttgaagacggccgccagcgaagtgacgaggttggaatcgtcgctgcgcaacaacgagcgccgtctggaaaccactggcacgaagctgcgcgacatgggcgtggatgtcacgcgcttctcgcagtcgcaggccgaagtcaatcaggcgctcaatagctcggtcgcgctgtataagcgctcgaccgacaacgtggagcgctacgacgccgccgtcaaggaagtgcgcacgacgcagcagcaggcccgcgaggctgagcgcgccgccgcgcaggaagcccgcgactcggcggcgaagctggaacaggccgcccgcgagcgcgaagaccagatgcgccgcgagcagaagatggccgagctgacggccaacgtctaccgcacgctggcccgggagaaagaaaaggcggctcaggccggggcgcagttccgcgcgggcggcacgcaggcgctcgctgcggcccgcgcggcggctgtccctgccgtgggtagcgggtcggccgcgagcggggctgctgcgggcgtacaggcgcttctcgacccggccaaggatgcggtcgcgacgctcgaccggctggaaaaggccgtcgaccagctcgacgaggaattcaaggcgctcacgccggacgccctgcaagccgctgacggcatcgacaagctggccgatcaaagccgccggctgcgcgctgccgccgatgcgctgaaggggcaggccgggctcgccgacgaattgaaccgccagaacaccgcgctgctcgcgagccaacagcggttcgaggaagcgcggcaagaagtgatccagtacgcgcaggcggtcgagcgcgccgacaagccgaacgacgaactggcggcgtcgttgcagcgcgcgcagaacgagatgaagcaggcgcacggcgaactgacgcgccagaccgaagcgttcaaccgtgtgcagcagcgcgccgctgccgccggcatcacgctcaacaacctgaccggcatcgagcagcgtctcgctcaggccgcgacgcgcgtgcgcaccgggcaggagcaggtcgcgcagacgatgacgcggttggagcagacgaccgcgaagaccaacacgcagttgaagctcttcaacgacggtcagcgtaccgcgctgtcgctgtatcagcgcacccgtggtcaggtgctctcgctggtctccgcgtatgtcggcgtgttcggtgcgctgaacctcgtcaacagcgcgatggatgcggcactggaacgcgagcgcgtcatgtcgcgtctgctcatcgcgaacaagggcaaccagactgcggcggcggaagaatacgactacctacgcaagaaggccgacgagctgggcgctgcgttcgggccgctgtccgagtcgtactcgcgcttcgccgtcgctgcacgcgacgcaggcatgagcaccgaggcgacgcgctacatcttcgaggcgttcaccgaagctgcgaccgcgatgcggttgagcggcgacgaaacggccggcgcgttccgtgcgttggagcaaatcttctcaaagggcttcatccaagcggaagagctgcgtggtcagttgggcgaccgcatgactggcgcgttcaacctgttcgcgaaggccatcggcgtcacgacgcaagagttgaacaacatgctcgaaaagggcggcgaagtgaaagcagagttcgtgctgctcgccgcacagactgcccgtggcatctacggcccgcaggcgaaggctgcgtcgaatagtttgctcggcgacctcaaccgcatgcagaacgcatggggcgatctgaagcgcgaaatcatcgacggcggcctcggcgatgcgctgcgtcgtttgttcgtcgacctgacgaagtacctgaagagcgacgacggcaagaagttcgcggagaacttgacgaaggtgttcgtcgctgcggccgacgctggcggcgaactgctgaaggtgctcgcggagaacgacgaaatcatcaagctggtggcggacaccgttgcgttcctcatcaagaacttcaaggcgctgctggcgatcatgctggcgattcagggcgcgcgcatcgcaatggtgttcacgtcgctcgcaacggaaatcctgaaggcgcgtgcggcgacgctcgcgctgaacactgcgctcggtgccggcactgcggcgtcggcgggtcgcgcgggtgtcgcgctgggcggcctcatctccgggccgattgccgcgatcctcgccatcgcggctgcgggcatcatcatcccgatctatttccagatgaagggcgagctggaatcgaacaaggtcaaggtcgacgcgcagaagacgatcaacgacttgaaccgtgggttcgaggtctcgcagcgcagcctgtccgacacgtcgaagaccaacgccgaacaactcgaacgtcaggtcacggcggcgtcgcggctgctcgaaatctacgacaagcagaaggagtcgctgcaagcgcagattcgcgagaacacggccgtacgccgaaaccaagtggcggttcgcgttgcgcagggtacgcgcgagcacgacatgaatttcccggccaagcagctcgccgctgtgcgggaagtcgagaacgaaggcaaggcactggaagcacagctcgccgcactcgaacagcgtgccgctccgcttcgccagcaagtcgctgccgccagccggcagatcggcgagacgaaagcacgcgaggcggctgcggagaacgacgcgcttgcggctgagttcaagcgcattcaagcggcggccgatgccgctgctgcgcgtgctggcaccgacgcaaaggcggcgaaggcggctgaggctgcgcgcaagaaggccgaggctgaagagaagcgtctggccgcgctcgccgagcgccggctgcgtctggaagaggacgtagcggagaagctgcgcgacatcgacaacgacatcgccaactcgcgcccggatacgctcgaagcgcggctggctgtgatcgacaacaagatcgcggatcgcaaggctgaactggaacgcatgctgcgcgaagccgacaagctcggtcagtcggatgcggccaagggcgagattcagcgaggcatcaattcgctgcctgagttgcagaaggcacagcagcaggcgacgacgcaggagttctacgagcagcggatcaacgacctgttgcaacagcggcagtcgtcgatggatgcgatcaacaccttgcaagaggccggactgctgacgaccaccgaagccgcaacccggatcgaggaagtcaacgcgcgtcttctgccgcagctcgaagcgttgcgcgcgaaggccgccgagttcatggcgacgctgggggacggcccgcaggcgcaggccgcgcgcgcaagcctcgaaaacctgagcgcgcagattcaggcgatgtcggtcgaactcagcgcgcagaagcgacaggtgatcgacgtgttcgtcaacggcttcggtcaggcgttcatggagaccgcgaccctcatctccgacacgctgaagggcgtgcaggatgccggcgacgcatggaaggcattcggcgacatcgtgctcaacaccatcgccgacatcctcatccagctcgcgcagatgattattcagcaggcgattttcaacgcgctgaaggcggcggccgagaacagcggcggcggctggggccagattatcagcgcggtcgcgagctacctgcacgttggcggcctcgctggttccggctccggccgtcgttcgtcggtgccggcgtacgtgttcgaggctgcgccgcgctaccacacgggcggcgttgcgggcctcgcgcccgacgaagtgccggcggtgctgaagcgcaacgaggaagtgctgaccgaagacgatccgcgccaccgctttaacggcggaatggcaggcggcgctcagcctgcgatggacgtgtccatcattaacaccatcgacagcgagagcgtggtcgctgccggcgcgaacacccgcgcaggacgccagtccatcttcaacgcaatcaaagctgaccgcagctcgtacaagaaacttctcgcataaggaatcgacatgggacacgtaattgcaactgtgactggcggcagcggcgacgaggcgcactacaaggtgctcgctgcgatcaagacgctcgctgaggcgaacgggtggacgacgctgcgctacgtcaacaccgggaccgtgcgcgagttgatcctcaactcgtccggcctgtcgggcaccgaagacatctacatcggcttccgcacctacagcagcgtgagcggcgactactacaacatgctcgtcggcacgtttaccggctacgtctccgcgaactcgttcgactcgcagccgggcgcgaagctgagtggtgtgccttgccacaacaacgcggtgacgtacttcatcactgcgaacgcgcaacgcatcgcgggctgcttcaaggtcggcactccggtctacacccacttctacgcaggcaagatgtttccctactcgcgtccgggcgagttcccgtcgccgctggtgtgtgccggcatgttcgacggtgcagcaccgaagcgtttcagcgacaccgactaccgcttcccgtatcacggccgcgagtcgggctatacgggcggctcttcgtcgaacgtgcgtccgtcgtacctgtggctgcgcgatcaagcaggtacgtggcgtcggctgtcgcacttcccgttctacaacggcccggccggcagcgatgcgtcgagcgcctacaacgcgctcgaaaactggaactacttgaccggcggcgaccaaagccgttcgctcgttccggccggcacgaattaccagccgcagccgatcatcctgtacaccacgagcgcgccggccggcgtgtgggaaggtgcggtgtacggcgagctggacggcgtgtacgccgtgtccggcttcaacaacaacgtcgagaacgtgttgcaggtcggcggcacctacgtcgacccggcgggcctgagcatcgccgatcacgtcgcggacattctcactgccggcgggcgtgcgttcgtcgtgttgcaggacgtgaatcaaactgactggcgcagctttatcgcattggagatgacctaatggcttactacaccggcaacttttcctcgttcgcatcgctgaagaattcggtcgagaccgcacttcaggcaaacggctgggggctcaacggcgacggcgtgctggaaaagaacggcatgtacctgcgcctcactgcgactgctgcacaactgctgttgcaggccggcaccggaagcgcaaccggcgcgctgcccggcgctgcgccgaacggcgtcaagatcatggacttcgagggttcgccgatgaatttcccggcgacttacgacctgcacatcaacgtcggcccggacgaagtgttcctcgtggtcaactacaacgccgacaagtaccagcagctctcgtggggcaagtcgaacatccagcagatcggcggcaccggcatgtggttctcgggctcgttcaacgagaacgccgcgtcgaaccagaaccagctcgtgtacaccagcgccgacgcgagctacttcggcttcggcttcggttggtcgggcatgggctgcggcctgttcgccgagtattacacgcaggcgctcggttgctcctacatccacaccggcctcgattcgactgcgtggcgtcgcgtctacaacggtgacggcaacctcgtcggttccggcgatgtcgttgcgggcctgctgcaagcgttgccgtcgatgttcaaccagaacacggtgctgctgccgctgctggtcacgcagcgtcgtctctcgcagggtcagactatcgttgccgacatggtgaacgcacgtctgtgccgcaacgacaaccacctgtccggggaaatcgtcacctacggcaccgaccgctggaaggtgtacccgttccaccgcaagaacgccgacgtgcgcaacggcgtctcgtggtcgacgggcgcgaaccactccggcactttcgcctacgcgatccgctacacggggccgtaactcatggcaggcatcaccggacaattcagcagcgaagtcgagcgcggcatcaacaacgcgatgctgagcgaggacttggacgacaacaccgaagtcgtctcgatgttcgacttttacgaaatgcgcccgggccttcaaggcggctacgggcgctggcgcgtgcatgccgacaaccattggggcgtcaccggccagcgcaagtcgaccagcttcttcgacgactactacaaccgcatctacatcgtgccggccgcactcgacgccggcaatttgctgtcgacgcaggtacgccacatcatcctgtggaatgcgtacgtcacgccgcagacgttggaaaacgccgcgctcggcccgcaggcaggcatctcgatgtcgctgccggtcggcgtgagtctgccgtacgagatggagccgctgcgcgagctggacttcaccgtgcagatcgaactcagtggcccgccgactatcgacagctatgcgaacttcactgtcgagggcattacctacaccgtgccgatcaccggccgacgcatcgtgctgttcccgttcgcgccgaattggggctcgcctgtcgacgagacggtcacgatgcgctcgtgggttctggccgccgaggatggcagcgagcagaccggcagcgagtcgggcgaagtgccgcgccgcacgctcgaatacaacatcaacctgcgcacggcgttgcaggcgcagcgatgcgagaacctgctgttcgcgtggcagtcgcgcttcttcggcgtgccgcattggggcgaggaagagcgcatcgacgcagacgtggcggccggcgctacgacgattccgttcgacaccttcggcctgtcgctcgaacccggctcgctggtcgcgctgtacctcgacgacgagacgaacgaaatccgcgaagtgcagacggtcggcgtcgacggcattacggtcacgaccgggttgcaatacgactggccggaaggctcgcgcatctatccgtgcttcgtcgggctcatgaacgatgcgatgagcggatcgcgcgaaacgtcgacggtgggccgaatgccggtcgcgttcgactgcgaaccgagcgtgaccccgggcaacgtcgcgctcaacatcgcgccgttgacctaccggggcaaggagctgtttctcggtcgcatcaactggcagtcggctatgcccttcaccttcacgtcggatgtcaagcgcgtcgactcgaacaccggcaagttcgtcgcgttctcgtcggcaggcttctcgaagatgtcgcgccggcacaactggacgctgttcaaccgtggcgacatcttctcgttccggcagttcctcggccgccggcagggcgtcgcgcgttcggtgttcatgccgagcggcacggtcgacttcaacatggccgcgccgatcctcgacaccgaagacatcctcgtggtcgagaacaacgaatacggcgcgctggccggcgcacacccggcacgccgcgacatcatcatcgagctgcacgacggcacgtatttctgccgccgcattctcggcaccagcgacttcgacaacttcacccggctgcaactcgattcgtcgctgggcgtctcgctcgatgtcgacgacgtggcgcgtatcagcttcctcacgctgtaccgcttcgagtcgccgtccaccaccatccgccacctgaccgactcgaaggctacggtagaagccatcatggtcgcgaagacgaccgaggattgacatgagcctcttgcaatacgaaagcgacaaggaactcagctcccgcgtggagctgtacttgttcgagagcgacgatggccgctatcgctgggcctacacgaccgatgcgcgcgaaaaggtgctcggccccatcgtgtacaagcccgagtcgatcaagcgcggcgagctgaagcagacggccggcgacgcgaatatcgagaacctgcaagtcacgatgccgttcgacaacccggtggcactggcgcatgtgccgtacctgccggcgcggccgatcaagctgacgatctacgcctaccagcgcaacgaccctgctgcggaaatcgtgcaggcattcaccggccacatcaccagcttcaaccagaagggcgctgaggccacgctcgaatgctcgcagatcatcgacaacctctcgcagacggtcccgtgggcggtgttcaagagcggctgcatttggggcttgtaccaagtcggctgcggcgtcgacaagcagttgtggaagaacgatgcgctggtcacgaccgtcaacggtgcggtgctgggctcgcctgagttctcggccaagccgaccggctggtacaccaacggcttcgcctacaacccggcaaccggcgaacaacgcttcatcgttgcgcacgacgccgccgccggcacgatcacgctggtgtatccgttcctcgaaattaacgggagccagatcatcgaggtttacgccggctgcgcacgcacgaaggaagtgtgcgcggacaagttcaacaacaagctcaactacgtcgggttcgatcacttcccggcctacaacgtcttctcgcaggggatcacctaatggtttgggtagccatcgtagttgcgctcgtcatggctgtagttggcgagctgcttcggccgaagccgaaattcaacgacccgaagccttctgctgtcggcgacttctcgttcccgactgcggatgcctcgcgcgtcattccgatcttcttcggcacctgcaagatgcaaggtccgaacgtcgtgtggttcggcgacctgacgatcatcacgctgaagaagaaggtcaagaccggctggttctcgtcgaagcgcatcgtcaccgggtacaactactacctcggcgtgcagctcgtgttcgcctacgggccgtgcgacgagttcatcgaactgcgtatcgacgacaaggttgcgccgatcaacaacaagacgttcacgggagacgtgtgcgccttcacgatcaacgcgccgacgattatcagcaacgacgacccgccgaacggcgtcaagggcaactgcaagctgtatcgcggcaccttcgagcagccgccgaatatgtacctgagcgagcagtgggacgagccggagatgaccgcgttccgtccgctgctgcacatggtcatggagaagtgctacctcggcaacaccgacacgccgccgcccatctcgatcatcacgcgccgctgcccgaaccagctcggcttgactggcggccggcacaacgtcaacggcgactcgaacatcgcgtgcgccgtgtacgaggtcatgaccaacaatatgtggggcatgaaaatccccgaagacaagatcgacgtggattcgttcatcgcctgcggcaacacgctggccgacgagagcatcggcatctcgatgctggtgcagaccgccatgctcggccgcgacctcgtggcggaaatgctgcggcacgctgacggcgtggtgtacgccgacccggtgacgggcctgtacacgatgacgctggcccgcgagattcccgacgaagagcaagacgagctgctgattgtcgacgactcgaacatcctgccggatacgttcgagttctcgcgttcgtcgtgggagatgacgaagaacacgatcatcgtgcagtacaccgaccgcaccacgttcgagacgacgccggtccaataccaagacctcgcgaatatcgacgtgcgcgggggcatgatcgactcggaagaattcagctacctcggcttcagcaactcgaccgccgcgatgaacaccgctgctcgcgtgtcgaagatgaaggcgtcgccgttggtgtcggcgaagatgtcgctcaaccgcatcggctaccagctccgtcccggttctgcgttctggctccgcaagccgaaccgtggactggcgaacgtgctcatgcgcgtcatcgaaatcaactacggcacgctggacgacccggccatcaagatcacggcgatggaagacatcttcgcggtcaatgccgtggcctacgttccgccggacccgagcgattggcaaccgccggttggcgcggtcgtgccgttcacgcagcagcgcatcatcgaagcgccggcattcggtgccgaggatatgtcgcggcgctacgtcatcacgatgggtgtgccgaacagcaacggcgtgatcggctacgacgtgtggaccgacaccagcggcggcacgaacttccagcagacgaacgccatcgacgcgctcacgccttcgggcgtgctggtgtcgggtttgtcgcgcaccgggccggaagtcgatgctgcgggcttcaccgtcacgtcggtcgtcggagtggctgacatcgaagcgggcactgcgggctcgcgcgagtcgggcgaaaacctgctgctggtcggcaacgaactcatggcatggcagggaatcacaaacaacggcaacggcacttacacgatcacaggcgtgtatcgcggcgtgctcgacaccatgccgcaggatcacggttccggttcgcgcgtctacttcatgtcggaaggcgcgggcacgaccaacgaagacggctacggcggcgacctgacgctcaacacgaagctgacgccgaagagcatcatcgacacggtgccgctggacaacgctgcggcgatgtcggtcacgaccaatgctcgtgcgctgcgtccgctgccgccgggccgcttgcgcatcaacggcgcggtcgtgggctcgggtgctgcatacacggccgacatgatgttctcgtgggcgcaccgcaatcgtctcgacgacagcattgcatcgcaggccgataccagccgtacgcccgaggaaggtacaacctacaacatccgggtctacaccagctcgaacgcgctgctggcgtctgcgctggacgtgtcgagcgcagcatcgaccggcaccatgcgcttcgcggtgtcgggcgatatgcgcgttgaaatcgaggcggttcgggacggctatgtgtcgtggacgaagctggtcggctacttcagctatactccggccgccggggctaccgccaacgaaatcatcgtcgacgaacccgagtacgttctggacgggggtggcgcgtaatggcacaggtagtcgttgcacaacgcatgtggcagcgccgcgacactgcggcgaattggtctgccaagaatccgatcctcgcggccggcgagattggcgtgcagctcggcgctacttcggacgagaccaagttcaagatcggcgacggcgcgaccccgtggaactcgctgtcgttcttcgagggccggctcatcgaaatcggcacgggcggcggttacatccgctggcgctacgtgggcgacgccgactggatcaatctggtctcgctcgaatcactgcgcggcccggctggtgcgaatggcgcgcaaggcccgcaagggttgagtgcatatcaggtcgccgtcgccaacgggttcgccggcacgcaggccgaatggctcgcatcgctgaaaggcgagaagggcgatcaaggcgaccaaggcccgcccggcattccgtcgcagcgtcgtatccagcgcatcacgaataccgacagcggctccatcgtgtgcgactggaactcctacgacgaaatccgcgtgacgctgaccgccgacacgctcgtcaacatgacgggtgcgcttgacggtcagggctgcgtgctgctgctgaagcaaggcggcgtcggcggtcacggcgtttcgttcggcagtaacgtgcgcttcaacaacctcatcccgatctacaacccgacaacgactgccggcaagtccgacaggctcggtttcgtctacgacgacgacgcgggcttctacgacgtgcaagcaatcgtggatggaatctaacgatggcagacgactacatcccgccgttgtcgccgaacatcgtgtgggtcttcaagggcaacgactacacgcccccgttgaccccgaacatcgaatggatattcggtgcagatgatgaaggcggcggaaacgagctacgcaaatccacctacatgctaatcctgacaatgtgaggtattgaaatgactgttcgcatctactcttcttccgacgctggcgctccggttctgcgcggcaacacgccgggcgacctcatcaacgtgctcgaaaagtgcctcgtcaccggctacggctcgaaagccggcgcaggctggacgaagccgtttaccggcacgaacgtcgcggcgttccagcaaggcgcaggatcgaacggcatgttcctgcgcatcgacgacaccagcactgcgaccagctaccgcgcagcgttcatgaaagcgtacgaagcaatgagcgatgtcaacaccggcacgccgacttcgttcccgacgccgacgcagaaggcgaatggcctgccgtggttcacgcactacagcagcggttcggtcgccaatccgcgcccgtggcgcatcatcgcggacgagatgctgttctacttcatggtgaacacctacccggagaacggcgacagcggttactactacaacgagtgctatgcgttcggcgacatcatcccgttcaagccgggcgacacgacgcacaccatcttgctcgggtcgtggaacgacagcagcccgaatacgtctgaaggctatccgttctacggcgtcggtatcagcagcacgatgggttcgagccgctacgtgatgctggccgcgcgctcctacacgaatctcggcggcccgatttacctcggctggcacaacgacatgaccaagggcagcaacacttggggcgtcggcaatttgtcctacccgcacggcccggacggcggcctgtacttgtccccggtgtgggtgcatgagccgcaggtttcgccgtacaacgtgcgcgggctcatgcccggcctgtgggtgccgtgtcacaacgagaacatcttcagccaagggcagaccttcaacggtcaaggcgagctggcgggcaagacgttcatggcgcgcaggcactaccaatgcactgcggtcttcgagatttccgacacttgggataggtaacgcgcgatggcgctcatcttcaacctgccgatgtcggggccggatggctccacgacgattaccgacaccacgggaaacttctcgtggtcggtgaacggcaacgcgcagattcaatccaacgcgctgctgctagacggcagcgacgactacgtgagcgcgcctgtcgatagccgggtgaagatcggcgctatcagtaatttccgcattgccttcgacatgcgcatggcggcagcggacaagggcggctacaggatcatcctcgaccagatcaacacgtctatcagcgcatggacttggcaggtctacacgcaagacggggtgcttgcgtggagcgtgtacaacccgagctacggcggcatcaatcttgtcggcggcactgtggatgttgcggacggcaactggcacaccgtcgaaattattcgcgagagcggagccgtcagaattgttcttgacggcgtgacgcttgcgacaggaagtgacggccgagactacgcggttacgccgatcataggtatcggaacgcgcgtctaccagcggtatccgtacgactacaaaggttcgctgcgaaacgtctcgctggaaatcaccgagccggttgtctcgtacggccgggtttccgcgttcgtagctaagtcgctggtcggctgggatcgtgcgcgcaatcgttcggcgatccgccggagcatcttctattcgttcccgcctatggaaacgaagaaagtgcagacggtcaaggtcacgcgcggcgtgccgccgtggtgggggccgagcgggtcgaccacgcagctcccaacctacaagctgcgcggccgagtgatgcagcgcgatcctgacggggtgttgccggatgcgccggtacagtacgcgcgcgtcgtgctgttcttcaggcgcttgcatacgctcgtagacatccagctctccgatgtcgacggctacgtgcaattcgataacctcatgccgggcggtcaggcgtactacgccatcgcgttcgacccggaaggcgcaccgttgcagaacgcggtcatttgggatcgactgacacccgagcccgggccgtaaggagaagtgccgtgagcccgaacaacaacgagcagaataggaaccgaagagtgacggacaaagcagggggacttctggacgccgcgcaacaggccattcggctcgaacgcatcgaaggcgatatgcgtctgctcacgcagcgcgtcagctccggcatggagaacgtaagcgccacgctcgcggccgtacaggtcgaagtgcgcggctgctcgacgaacgtgtcggagctacgcggtctgcaaggcgcgcacgactcgaacaaggtagcaatcgacaaggtggagaaatcagtgtcggaacttggtgcgaggttggagtcgtggttcgatgagttcgaggccaagcaggaacaacggtggcgcgactactcgaacaaccgcgatcaatggcggcgcgagcacgaagccgagaacgaaaacgtcaagaaggacttggagaaggaaatccgcagcgtgcgcgagaccgtcatccgcttcgtcgggttcggttccgcaatcggcgcattggcgggcgtgatcgttggcggcttcctgtggaacatcaactaccgcttcaacgacaacaaagaggacacggatcgagtcgagaagtcgtcggcctacaaccggcagctcatcgacgcgatgggtgtagaacacggcaaagagctggccgacatcaagctctatctcgctcgcgggggccgcatccccgaagagccctacgttccgcaatcacagaggaaagaaaatggacaccaacaacagcagcccggccaacccggaaagtaagatgccgttccgtcgtcgcgcgtgggagttctggcgccgcaaccagatcatcctcttccagctcccggtcatgctggtcttcctcatcggcagctacatcgtgctgaagtcggtcgactctcgcatcggcgtcgaaggcttcggcgacatcttcggctacgcgctcaacgcggtgcgcatcacgctcatcatcttcaccacatggtggatgaagaagtggtgctggttcgacctgcacgaccgcaccgaactcgaactgttcgacctgcgcaagcaaggcaaccgcgacgcgcactggatcgtctggaccgaccgcatcgagtggatgctggcgctggcgttcgcgaccttctggtacacccgatgagcgcccgggtcgtagtcctcgctgcggccctcctgctgggcgcgtgcgcccggccggcagcggtacccccggtcgaccagaccgtgctcccgccggccgtggagagcctgccagcggccacgccggagccggtcgccgagcaggtcgtctcggcccaacccctgccccgggccgagcaggcggtttcggagaccgtcacggagccgcttctggctgcgcaggcggcgctcgcggaccttaccccgctactacccccgccgccggcccgggacgcggcttgccggcgcgctgcggcggccctgacgctacgctgggaagtgaccagcccggcgttctaccggaagcggctcgaactgccgatctggccgggcggggcgtccggggtgacgtgggggatcgggtacgacggcggccaccagccccgggcggtgatcgtcgacgactggcacgaccacgggcaggtcgaccggctgggccagaccgccggcatcgtaggccagccggccaaggtggcgctgccgcgcttccgcgacatcccgactggcttcgaccacgccagccgtgtgttcgaggaacgcagcctcgtcgagtacgagcgccgcaccgagcgcgcgttccgcaacggcttcacggagctgcggccgaacgcatgcggggcgctaatctcgctggtgtacaaccgtggcgcggcgatgaccggcgactcgcgacgggagatgcgcaacatccgcgacaactgcgtgccgaagcaggactatgcctgcatcgcttcggagattcgcagcatgaagcggttgtggcgcggcacggtcaatgagaacggattgtctgcgcgccgcgaggccgaagcgatcctcgtcgaaaccccgtaaggagatgagcatgtggacgaaagcaatcgcgtggctgttcggaacggcgatgggtcgcggtgtgctgcttggcggcagcatcgcgataggcatggcgctcggctggtatgcgttctcgacgcactactacaacgagggcgtcgcgtcttgccaagctggccgcgccaccgatacgaacgcggccaacgtcgcgcaaggtgaaaagaacatcgccgacaaccagaccgcttcggaaatcggcaaggccgccgacgccgaagcagcgaaggtcgcagccgatgccgaagaagcgaagaacgactcgaaggagaccatccatgatgtgtacaaaaagccgcccgtcactgcgcctgttgctgttggttcttgtgttcaccctctcgacgagcgggtgcaagaccggatcggcaaagcgcgagctgccgcagttgaagcaagaagcgcccctcgttaactgcaagcagcctgcgtcgccggcagtgccgcgcgagccgaaggccgacgagtggatcgagtggaacccaccgcgcccgggcaagaccgaaggcgaagcgcggctcagcgagcgtgcggtgaactggatcatcgacgttctgggcgtggtgcgagtgagcgaggggtaccgccgcgtcgagcatggatgcctcgacgacctcgaagcgaaagggctcatccggcagtagttgacaggcccgaggcgctgcattacggttgatcccgctggtggcacttcgcgttgcatcggcactcggcagagggacagcggcgcggtgaatcggcgctccgcaccgcagggaacgaggaaccccggactaaccatccggggtttctttttgcgtcaagaccaagtgcgtcatgaccaagttcgtcaagacccaaaaagaaaccccgccacgttgccggggcggggtctcgggtcgctgcggcgtcgcgccggagcagtgggtatcgaggcggcggttctgctgattccggtgtccgctcgtggagcgctgcgccggctggaagggcaatgtcgcgtcgatgagtcgaccctaatgcgatgcgctcagggtgtcaacaccttcgtcagtccttccacgtctcgaccagcttcatcatcttcttgcgcgccttctcgacgccggcactccacttgtcccacgccttcgtgtcgacgtgcgtgaggatttcattgcgcgccatttcgctcagcacggtcggcggcagcgcgtccagctcccagctcttgtcgccgaagcgctggcggtatttcacgaagcgcgcgtcggtcgtcttggccgggttcggcggcggcttcagctcttcgatctggtcgaggttcaacgccatgcgcttcagcgtgaactcgccgttccagccgaacagctcgaagcgctcttcgaggtcgcgcgtcatgtcgatgccgctcgggtcatggtctccgaagtgcaggatcacgacatccttgccgtcgctctcttcgatttcccgcttcgcgaaatcgcgcacgaccgatgcgctcgggtagccgcgcgccgcgagcagcggcacgtcgaactcgtggcacacgcggctgaagacgccgaccagcgcttccttctcgacgacgaggaacaggcgcttctcctgcgtcgcccacgggtcggtgtggtactgccgtgccgacgccgtgagaatgtcctgcgggcgcgaccaacggctgcgctgctcgaacgagcgcgtgcggtcttcgatggcgtcccaatcaatcaggccggcgatgcgcgcgtcgttgacgatgctcgtggtctgcttgtacgacttctcgttgttcggaatgatgtcgcgcgcgacgagctggtagtagagctggcgcacggtcagcgtgtaccccgcatcaagatattcttcgatgatcgcgttgatcctgtcgatctgttgcagggtcttcgtcttgaaggtgatttctttgtagcgttcgagactcatggcactcggctcctgttagcggttggcgggctgttcggcggcccggatgtcagtggcgcggatggattcgatttcaggcgacagctcgatgcgttcgaccgcatagcccacgtcgcgaccgtagtacacgccgcgcacgtcgggcaccgggtagatgtggtagctgccggcgtgcgcgtgcagcgcgtggtggatgcgctgctcgatctgcgggtaggtgtacgggttgtccgggctcggttgcacagtgcgcacgccgatgccgacgtagccgctgcgcgccagcgtctcgcggaacagcgcggtgtggcccgcatgccacggctggtagcggccgatcatcgtgccctgcggcgtcaggtagcgcaggcacgcggcaatgcgttcgagcgtgggctgcatcacttcggccgtgacttgcaccgcgacctgctgcgggcgctcgaacatttcgtcggtgtccgggtagcggctcttctgcaccgtgtccatgaaaacgatgaggtcaggtgcgaacgcctcgcgcgtctcttcggtcgggcacacaaacgacgcgacgacgaggccgccgttggtgtcagccagctcgcgcatgcgctgcgcctgacgcacgcgcccttcgtcgctgaagtcccaatcgctgtacgtgctgcgagcgttgtcgccgtcgatgtgcgttgccggcaacacgcgcgcgagcgctgcgccgagggtggtcttgccgctgcccggcagaccgcagatgagaattcgcttagccacggcgggcctcctgagcgaagttggtcaggtactcgacggccttcgcgtaagtccacgcatgcacgtattcctcgcccttggtcacgtcgtcttcggtgatgacggcccgcacttccgtcgcggtccaatcaatcgagatgacgcgcttacgccagccgatcttgaccgggccaaactcggtcatggcgagccaccacgggctgtttcgacgaatgtcgtcgtagtgaggcacgttcggccagtagccgttcggaagttcttccgcgtgcttgaccatgatgcctgccagcacgaatagcgcgagcatgtgttgcttatccattgttcgattccttctgtgcgcgaagttcttcgcggatttccatgagcaacaggccgagatgattctcgcccttgccttcgcatacgccccaaaaacggtcgccccaccaattcccttcgacgagcttcgacttcccggtcttcagcaggcgcgaccgcagcgggtcggtgccgaacttctggcgcagcaggtcgcgcatgacgccgaccttgatctgctcccaatcttcgcgcagcgttgcgtgcttgccgcgctgcttcgcgccagcggcgctcggctcgttgcgaatgcgacggcgctcgtcctcgtcgagcgtcttggctgcttggaaggcgtgctccacggtgcggtacgagtgcccctcgaaggcgatgcagcatgaccagaaattcgagaggaagcggtacgggccgttgaagctgtcgatggtcttcatggtgtcccctagtggaagtcgatcttcgccttgctgaagagctggcgctgcttctgcatgtcggtgcgagtgatctggtcttggatgggaacctgcacgttgcgattcatcatctggtgcaggtagcgcggctctactgcgtgcccggtcgcgaacttcgcaatcgccatgagaatctgaggcgagtgcagctcgaagaacgtgccggtcatcgaccacgggtgcggccggatgtgcgccgcgatgtcgagcagttgccgctcggccttgcgcacgttgagcggcggctggatgccctgcttgcgcatggagtgctcgacttcgctcgccgcacgatgcacgacgaggtactgcgcgcccgggaaccggacgagcagttggtcgaagaagaacagtccggccacgtccgacacgaacacgcgaccggacggctgcttgtcgatcttctggcccagctcagcgatgcttgcgcactgctgaagcgggttgtgcatcgacgacacgcacaacggccgaaggaactcggccatccatgcgctgcggctgcgcggcaggctcagcatgatcgtcaggtgctcgtatgccacgtcagcctcctacgcggttgtgctcgtcgctgagcttgtcgagctgccgggcctcggcgtagctgtcgagcacgcggacgaacgcatcgtgcagcagcgtgccggcgggcacgtagatcactgtgccgccggtcaggtcgttgcgggtgtagatggtcggagccgcgcccgggatgagctggccttgaccttctggcgtcgcctgcatgcgatccggtgggcgcgagtcgaactcgcgcaccatgccgtcagccggcccaccgacgaagaagcctcgaacggttgcattcatcgcacgtctccgtcgccctgcaacgtgccgcgttccttgcgtccgttgagcttttcgcggttgtcgaacagcagcttctcgtagccgccctcgcagcccaccagcggccccgtgcgctcggcgtactcgaccgacacggcgatcaccgcagcgagcgcaccgcgcaactcggcgatcttctccgcacgcttctcggcgctccacgtcgcaccatcgcgcatcatcttcttgatgacgcccagcacgcggccggcgtgcgcacacagggccgattgcaggtcgtagccgctgatacggacctcgcggtactcggcgtcggcgaggcgctgcatgccttcctgcaccagcacgtcgaagcgcggcagctccggggtctcggcgcacaggcgcgcggcgtaccactgcacgtcgcccagctcgtgccacgccttccggtagcgctcgacgcggaactcttcgcggatggcttcttggtcgaacagctcggccagctcgccgacttcgttcgacagaccgatgccggtgtacagcatgccggcgctgacgttgccggcgagctgcacgatgtcggtcgggtacttggcggtcgtgacggtgaaggcgttgtacgcctcggcgaagacgcgcgtgggctcgacgcgcgcagcacgcgactcgcgtgcggtatcgagggacaggatgctcatgcgcggcccccggcggccagcgcctcggcgaagtcgttgctgtagctggcgtcgaacttcgtcgccatgtcgtgcagcacgagcgtggggccgccgtgcgcggccgggatcatcgcgaagtcgacaccgcgcacgagctggttgcgcgcaccgtcgtcggcgatggcgtggacgaccagcgcctcggggttctcgcgcgcggcgcgacgctcggccttcaggatgcggcgcatggtcttgccgccgaacgccttgcgcaacttctcctgcggcgagccgtggtcgcggatcgcgaggacgccggcaatgccgcccttcgacgtgcgcacttggcgcttgttcttctgctgctcgttcgcgttgtcgcgggcttgcagcaggaaggcgtagttctcgtcgacggcgagcatgcgcttgcgccacgggctcagggtcttcgccttctcggaatcgtacgaacggaaaatgcgcttcaacaggttcatcgtgtgctccttggaaatgaaaaagcggcccggccgatgtcgacagggccgcttcgatgtactacgtcaacgccacgggctcagcggccggcgacgaacttggtctgcttctgcacccggccgcgcttggtctcgcggaacagcacgatggtcgtgttgtcgtcggccatgatgctcgcgtcgtcgagcgcattgccctcggtcgcgaacgggccgttcatggtgctggccttctgcgaaccgtcttcctgcgcggtcagcagcaggtacgcgaactgcttcgcgcccttcttgccacgacgcacgccgaccttgcgggcggcagtcttcttgccggccgggcgaccgcgcttggcgggcgcagcggcttcggccttcttcgcgacgcgcttggccggagccttcttcgcggcggccttgcgtgcagtcttcttggcggccttcttggcggggcgcttcttcgcgaccttcgcctcggtggcttcggcgttctcggacatctggtttctcctagcgttgttgtcgacaactcgcggaatgcgagcggggttcccttgcgggattcggttcagtccacgcagtacgcggggacttcggtgcggaacgtccgacactcggacggctgcgtgatgtacaggcccgccatgcaggccagcagcagcacgacgtagacgatcttctcgcggcggctcatcactcgcagcccacggtggcgttcgcgcgggtcgggtgcgcggcggtgtactggctgaagtcacgccagccttccgagccgccgcacgcgaagccccagcggcgcacgatggagccggtcatgaagagcgtccagcacggctcgtcgttgttgccgaacagttcgagcaggtgcatgtggtcggcactcaggcggcggaagtcgcccgtgcggaactgctgcgtgtagtcgaacttgtgctggcccgggaacttgcccttgttgcgaacgacgctgccttcgacgtacgtgcggccgtcgcccggggtgaacagtcggtgcatgtacgagacgtgtgcgtccatgccggcggcgctctcgtcgatggcgtgctcgtagcaccactcgctcgtgtgctcgatgtagcggccgtcgaggatgagcgaggcgctgacccacggatggtcgtgcagtgcgcggtcgtcgtcaccgtggacgaacttgtgcaggtacaggttgaaccagcggttgcgcgggattatgtgccagcgcgtcaggtacgggcgacgcgggccgccgtcgatgccgtcgagcatgatgaccttggacggcgagacgagacgcgcatacagcttgaacgcgccgacgaagaccgaccataggccgatcatcgagagcacgtcgtagaagcgacgggagaccttgggagcgatcatggcggggaacatcctcgggatgatggggtagttcatgcgtcgaccgccgcgtcggcggtggccgggccgtccgcgttggtcacgtcgacctgcggacgaacgagcggcaacggctgcgagccgtcgaggttcttgaactcgatgtagtagcgcgtgttgagcgtcttcagtccggtgtcgacacggttctggaagacggtcagcaactcggccttcgtcagctccccggcgtgcatgccgccttcggagacgacgcggaagttctcggtgtcgccgctcgtgagcatggcgaggttgtggcggtcgaggatgagcttgtcgagcaagtcgcggatattcggcagttcggcgaagtcgattttcattggttctctcggcgtgagatgaagagcggcgtatcgtgccgcaagccgccgggttgacccttcaagcgctggggagtgcgccatccagttgaccgggggtatcgcctcggcgaccccgtgcagttcgtgatttaccccgtagggggacgaagtaaattcgttactgcggggccactctagcgccagcttttcggcttgtcaacacccttcctcgtgtccggcggccggctcagccgggccatcttgcgctcgccccggaagagcctgtcgcgcagcatcttctcgctgacgtgcgggcagtgtcgcttgatctgctcgaacgtcatttcgtcgccgtcgatggcgtacagccgaacgcgcgcaacctctttcactgcgtaatcctcgtcgtcgaatttctgcctgctcatagcgcccgcccgtgggtctggatgtaaacgtcgtgcagcatctcgtgagcgactgccttgcgaaacgcttcctgctgcacaagcgcatgcgcgaagtcgcgagcgctcggctccttcatgccgagatgcgcggtcatgcgcagcgcctcgtcgatgatggcctgcggttcgccctcggcgtagccctcatcggcgagcagcgcatggatagcctcgcggtacttcgcgtgccgcgcgcgctgccgcagcatcgcaatgccagcgatgacgttggggccgatcaccagcagcaaccaatcgaaccagctcatacagacctcgcgtgtggacgctcttcgccttccttcggcgcaggaacgtggtggagtgtttcgagtcccttcttgatctttgccgccatcgctttgccgaactccgatgcatcgccgtacatgaggtcgaggtcagggtcagcgcattcggcggcgacgttgcgcagcgtgtcgagcagcatcgggagctggtgctgcgcgctgtagttctggtggatcatcggccacgcgccctgcgccttccaccactgcttgcgctcgtgctcggtcagcgcgacgtattggtcgatcatcgccatcgcgaggaacggcgaccaaaagcacgtatcgaccggcgtgatcggctcgcccagctcatcgagcgcgaagtacaccgcgaatacgggcgtcgtgccgatgagatacacgggctcgtcgagcgggtctttgtacgtggcgatggtgtagccccggtacgcggccatgtgtgcgtagcggcgcttgctggcgtcagggagtggcatgcgaaaactctcgttgaagtacgggtcaagggacgctgaggcgtacaagcacgcctgcttgggctcaggttgcgcggctctcatggcgatgaagctgcgctcgctcacgcgccgcccgcgtcacgcacgagcacgacaggctcgccatcggcgtctccgtcaggcaggcacgaagcgagcacgtcggccgcgccctgcgtgtcgccgagcacgagcagttggatcgcggcgcggatcgcggtctcggtctcgaccgctttgcgctcggcggcgagcacgtagcccgcaccgtcgcacagctcttcgagcagatggcgcaaccactgcgcggtcgtaaggtctttgcgatccagcgtcacgccgtacttcttcaggccggcgtccgcgcgctgacggatgatcgcgatgaggtcgttcgtggtctgcatgtcgctcatggtcaaaagtccttggcaaaatcacgttcaacgcgcagcaaggccgaaacctttgcgtcgaactttttcggggtgtcgatgaggatgtccgccgcagcgcacgcgatgacgggagacgtgaagtaggcttggatcgggtgcagcacttcgccgaagtcgtcgacgatgtagtaggcaacgtggacgccaatgccgccgtcgagcacgaccagcgggccgccgtcgctgcgcacttggtcgctgtgcagctcggcgatgaacacgtcgcggtagggttggatgcgcttgaacttcatgcggctttttccttcaggtggtcgagctgccagccggcctcgattgcagcgaacaaccgcagctcgctcgcgtcgtcgacatcgaggcgcaggtactcgatgaagctgtcgatcatctgcggcgtcatcgggcgcttgtcgtagaaacggcggtatgcactttgcggaatcatgtcccacaccgggcacaggtcgacgatacgcttgccttcttcgcgaaggtggcggcgcatgatgtcgcgcaccgtcttcgggttcttcttgaccgtgatctttcggccagtcgacggacggaaactcatagcccgatgtcctgtccttcctcgcgcttcagcagccacatgggcttgcgcgagagcatcggcagcgggccgatccagccatcgacggagccgtggtgccggttccatccgtagttgtcccaccagcgcccgcgcatctggccgtactccggcaaccacacggcaatttccatctccgcgtgctgcggcagcgcgtgcgggtacgggtggtgccagatggcgtagaagccgaactccggcgggtcttcgagcacttcgatgtcctcgtagcgcatcggcccggcccagccgagcaccatgccggtgaagggcacgaacggcgtcttcaggcttggcctgcgctcccaccaatggccgttcgcccagcgcatcaccgcgtacatgcgcgggtcgtggacgattgtcgggttgcgcgtcaactcgacggcgtacagcccttcgactgtcggatcgtcgagcacttcgagatgttcaatcttcgtcatgcggtgcctcaacgtgcgcgcgtagtggccgcaggcgcggcagcgggccgatccagccgtggacttctcccctgaagtattggtcgctgttgaggtagcaccagcgatccccgaaccacatgaggaagacatcgacgacgagcccgcgaccgtgcgggtcgtctacgcggcaagcgtagacgcccgtgtcctgcggcagtccgatttcttcgtactgcaccttcatgctcactcgcccttcggcagcggcagcgcgtagaacagcacttcgccgttcatgcgctgcacggcgacgaccgcgtggccgagcttgcgcgcggtcttgatcgaggtcgtcgtgtcggtgctgacgccggtctcggtgccgatatgcacgccgcccgggtactcgtgagtccagctcgcgcgctgtgcatcgagcacgctttccagctcttcgacgcgccgcttgtagcgacgcgcgtcggcctgcgagatggtcttggacatggctcagacctcttcgcgagcggagtgggcctcgcacttggtcacgagcagcatgaagtgctcgtgcggcaggcccagcagcgtgtcggcatcgagcgtggcgagcgcttccttcagcgcggccttgccgtggtgccgggcgaacagcagggcgtagtggcgcatcatctcgcgcatggtgtcctgctctcggcgcacacgcgctgcgtcccacgcaccgccgcgctcctgcttcagcttgtcgacctcgcgcgtgcgcacgcccagcaaggacgacagctcgcggttcttgtccgacagcttggcgacctcgttggtgctggtctcggcgatctgctggtagttgcgcatgtgcttgttgatcgagcggatagcacgcagcgcgaggcccacgtcgtcgatgttctcgtagtgcgcgcccatgttgcgccagccgggcaccttgcgatccagctcgcggtaaatgacgttgagctgccgctcggcgtcggcttcgcggaagtccatcatcgcctcagccgcagcgtgcgcctgctcgccgacgttgcgcagcgcctcgctggcgtccttcgtgtccagccgcagttcgacctcgacgacctcgcgcgcttcgccttcatcgtcagccggccgccacgtcgcgagccacgtcgcatggtcgcggtaggtaaacttggtgcggtggccgtcgccgtcgcgctccatcgtcacgtagtagtccgtgctgtccggcttgcggcgcgcgtcgatcacggtgtaggtgccgcccgagatgacggagaagtagcgctcgccagcggccggcggctgctcggtgccgtcgaactccacgttctcgatgaagtcgcggaacagcgactcgatgaggccgtagcccatgccgagttcgggcggcatgccgacgcggcgcgagcgtgcaggcttgaacgacacgtcatgcagctcggcggccatctgcgcgtacgggttgcccgggacagcgccggcagtcgtcggtgcgaacaggtcgttccatgcgctcgccgtggtgaacgtccattcgtactcgccgccgcgaccgttgtcgacgcgcagcatgcggacgtggctgtggccctcgcactcgtgcgtgctgacgaccatgaagaagcgtgccgggcggttgcggtcctgccagtaggtgccgaccttcggcgcgaactcgtagcccgggtggccgaccgtcaccgcacgcgcttccttgcggtcgctcgctgcgcccttggtcgtctgcgtcttgctgaagtcgcggcgcatgatgcgctcgatgaggctcggcgtgcccttcatcgcatcagcgatagcgtccgggctgaagtcgatggtgttgatgatgtggatttccggctgcttcgagaacgggtactcgcggcggtgcggcttctcggccgagaacacggtgccgtcgtgcgcgttgaagaagaagctgtgctgaccgatgaaggtctcgcgaatccacttgtgcatgcgctgcgcttccgcgcgctggtcatcgctggtgccgacgacgccgccggtcgcatggatttcgcgcacgatgccctgctcgtcaacgcacgcagcgacggacacgatcatgggggtggtagcggtattgcggaactgcttttcgatgtgatgagacatttcggcgtttcctcggttgagttaggtggtgctgacgtgaccggcggcctcgcggtcgagttgaaggtctgcaatgtcacgcaacgacgagggccaatcgtcgagcggcacgagtccgtcctcgtgcatggtgatctggtcaggcgtcataccgcacaggtagtacgccttcgcgagcgagaagcctgcattgaggcggtagcgcttcgctgctgcgccccacttcaccgactcgcgctcgcgccagtcgatccagccgcgtgcgttgcacagtcggcacggccgcatttcgtactcgtcatggatgatgtgcgtgagctggtgcttgtggccttcgcacttcgggcagacggtgcggtcgaacagttggagccatgcagcgcgcaccttcatccgcagggcgagaattactgcgcgggtcagcagggtggtagcgctgcgcaggcgagacaaagggggtaccggagcgttccgaagagccgcaagcctacggcccaacattttcgcctctgcgatttcgcggtgcgtgtggcgcatggctgcggtcactccatccgggtgacggtgaggaacgcaaacatggcgtcgttgctggcgctcatgtaggtgccgcgttccatcttgaaccgcttcgacttgtgctcggccacgccgcgcaccttggcgatgccgccgctcaggatcgagttctgctgcttgaagtatttctgtgcctcgttgttgatcgcggcaatgttgccgttgtcgagcgggatgcgctggcagcgcgcgtgcgactcgccgatgtcgagcttgctgagctggtcgttgagcgagcccggcaggaagatgagccggggcttctcgacgatgcgcacgcgcgggttggcgatgtgcttcttcagtgcggccttcgaccccggcttcttgcgggtcttctgcgcagtgttggcgctgctgttcgtgctggcggatgccattgggtgatgcctcctgttccggggaagtaagcggacaagaaacatactactgcgcgcacccggggtcgtgtcaacccgggcgttctcggtcgtgaccagctcgcgcgccgggccgatgccgcatgaaggtccggctgggttgccgaagcgggcgcaatttcggaaccggctaggtcggcgaagcgagagcgcaaacggaaccggctggctttgcgaagcgggccgaattttggaacgggctgggtatccgaagcggggacgtttttggaattgctctcttgcatgtacgtgcgtgcgggcatgcgcatgtgcgcacgacgcgcgctcgctcgcacgcatcacgcgcggttctcgacgcgcgcggcgcgcggttgtcgtgcgcccgcatgccggcgacgcgggcgcgtcaatgctgcgcgcgctgcgcgttgcgcggttcccttcatccgggcgcgcttgccgccttccgcgcttcctgaatgcaaagtaaacggactactgcgcgcagtaaaaaaatacttgcgcggcgcgcggaaccgtgtagcctacgcataccggcaacgtcgccggcatcgcaaagggtcgcaaacatggcacgcatcgaacgctccgaattttccgcccatgccgcgctggccgcgtcgcgtggcgcgcaggctgcgcgcaaggtcgaaaccgcgcgcaaggtccagacgttgcgcgaccttatcgcgcgccttccgtttcttttctccgtcgccgttgccgcctttgtcgcggtcgcggccgtcgccgtgtccgtcgtctaagggagcccgaatcatgcgccgttatcttttcgtttcgtccgctacgcttcccgtcgtcgcctacgcggaaagcaaagacgcgatgcgcgcatacgtgcgcgacctgctagggattccgcacggtttcccgctgccgcgtcatgcggttgtgtccatcgcctaacaattcaccagacaagggagattcaccatgcaacgcattagcctttcgcaagccttcgcacagtggcaagaattggccgcagacattccgcaagacgacgcgcccatgctggcggaatcgtggaacgattacacggattccctttgcaaagatggcgcattgtgcgacctgcaataccactacgcgcccgcatacgatgaagagatgcccggcgacggttcgcgcttcgatccgctgagcgatgaccgcgaattcatcctagacgcgctaggcgtcaccatgcgcgcaacgcgcaaggatggaccgcgcgaaggatgggacgcgagcgcgtcacactggcgcgtcacgctgcgccgcgaccgcgcgagcatgacaacggattacagcatgggcgcggcgcatacgggctcgcctgagctggcggacgtgctgaattgtctaatgcgcgatgcggaatgcggcgcgcagtctttcgaggatttttgcgcggaccttgggtatgacacggattcgcgcagcgcggaaaagacgtggcgcgcgtgcaaggtaacggccgtcgggctcgcgcggcttttcagcgatggcatgctgcgcgacctgcgcgaattgttcgaggatttttgatatgtgcgagcttgacgtaaccgcaatcgtcgccagtatcgcgccgcgcgattactcggcatccgttgctgagctgggaaacgatgccggccgcattacgtgggaagccgcatgcgaggatgcgcgcgagcttttcggcgagcatttcgaccgcgccgcattcgatgagtatttttcgcatttcggcgcgtgggacgctgaagaattggccgcgcatacggatgaagaatgcgccgcgcttatgctgcaattcatcgccggcgacatgcgcgaggccgatttttccagctatgccgacatcgaaggcggcgcggaaccgttcacggatgaatggtggccgcagtatgaaaccgcaagcgaagccggaaccgtcgccggccgttttttccgcgcagacgatggccgcgttttttactacattggagaatgaacatgcaaagcaaatgggcaaagacaaccgcgcagcgcatcgcatccggcgagctggcggaatccatcatccgcaaggcgcgcgcgttgctgcgcgatgccgtgaacgctgaagagtatttcaagcgcgaaccgtcgccgtctgctaccgctgcggaagcgtgggagctggtgaacatgattagcacgcatgcgccgcgcgtcacggatgcgcaagcgcgcaagggcgcggaatggctgcgccgccttgtctacacgtcgcgcggcacggtgcgccgcacggaagccgcgcagcaattcagcgatgcggacctgcgcgttttgcaggcttgcatcgcgcgcccggccttccgtctggtggagctggaaccgcacagcgacggccgatacctgcgcgaccttgcgcccgtctatcgctgcatcggcgacaacggcgagtccttcgattacacggcgagcgcgtggcagtctggcggcgcgttcgcaatcctgcgccacgcttaacccttcccatccgtgataagcccggagaatctgaaaatgtacagcatcgcaaacaacgcaaagcccgccattctgacgcgcacggaatcgcgcatccaatcgcagcgcgacaagcgaacgcgcgacacggaagcgcgccgcgcaaagtatcggcgcaacgctgcgcgctatctggccgcgtctttctggcaagggtcgcgcgacatcgccgattttttcaagggtcgcggattcgatcatgcgacgttgcaggacgcggaaaacgattgcatggataacgtcgatttttcttatctgtattcccgcgactatgcgcgcgagctggaaaaggaatacggcgacgacgcgcgcgaattgttcgcgtacctttgcccggatgcgccgctgagcgtgtaccgtgagcaaatcgccgacgacatgacgcgcgcggttgcagactcgcgccgcgcggattatgcgttgcagtttttcgactggtgccgcgatgcggtcgaggatgcggccgattcttccgggcttgtctggtgctggctggacaaggccggcaagcctacggatcaggaatacgacgcgcacgcggtaggcttcgcatgctcgcgccgcgcgttccttgatcgcagcgcggaatggtggccggaaaaatggtgggcgaaaggtgaaacgacgtggagcgattacgcgagcaaccgcgaacgcatggacgcggccgacgacgtgctaagcgaatttctcggcgagcatctggaaagcgaaggcgcggaccttgaatcgttcgatgagcgcggttcgcgctatgcggatgatgattattggccggaatacttcagcgactacagcgaagcgcgcgagcaatgggaaaacgacaaagcaaagatgcgcgcgcgtctgcgcgagatgatcgcgaaccgtgcgccgctggaattgcgcgccgcgcttgtcgcgagcgtgtacggcgagcccggccgcgcggccgatgaatccgaagattgaaagggagctaacgacatgacgacgattaccgcatacgcatacaatgccgcgcttcattgcccgcgctgcgccttccgttatttccgcgtcgatcctgcgaaggtgccgccgggcgcggatgcgctggacggttgcaaggatcgcgaagggaacgcgcccgcgccgctgttttcgacagacgcgaacgcggatggatactgcgacacttgcgacatggcatacggcgacgcggaaccgcgcgcgcacgtcctgagcattgacgcatggcgcgagcccgaaggctggacgtggaataactggcacaagcgcggcacggtgccggttgcatggtgcgacctgagcccgcgcgcgttgctgcggaacctgcgcgcgttcgggctcgacctgccgccgggcgcggtatgcgtcgaggatgacggatacaacgtcgagattcaggcgcgcggcacgcgggaaccgttgtatgccattgcctacggcgaggcttgcgcatgacggaaccgacactaaacgaaaaggcgcaaattctgcgcgctggcattctggcgtatcgcatagaacgcggcgcgcgctggctttgtttcgctgccatcgtatgcgcgggcgcgttgccgctggcatggggagcgttccgggcgcatggcatcgttagcgggctcgccgtgctggcgctggtgctggcgctatgctggcacgtcaagccgcacgggcgcagcctagcggcgcaagcgcgcgagattgaagcccggttcaagccgcacgattaaaagcgcgctgcggcgcgttccctgcatcgcctaccctgagcccggccgcgtgccgggctttttattgcctgcgcgtctaggcgcggcttagcagccttgccggccgcacgtctgcccggccttccgtatcccttcgcctgagcccgtgcccgcatcgcttgcggccgggcttttattttgcccgctgcccggccttgcccgggctcgcatgcgtgccggcctgcccgctgcccggccttgcatggtggcgggcttattcgctgcccggccttgcatgcgggcggcatagctgcccggatgcggcaacgtggaattaatgcagcgctgcgccgcataggtgcgcgcgtgcggcctttccgaatttatttattgcatcgcatgcccgcatgcgtgcgcgccgcgctgcgcgcgttgcagcgcgcgggaaagggataaagggatagcgggctcgcgagtaaaaaggtacttccggcctgcgcgaaggcgtcgcggggggcgctgacctcggtgctcgcgcatttttcggaatttttgcgtttccgtctccaatcgacccccgggccgcccggaaattgccgaatatccgccccgcgcgcatttaattcgcttgtgacagtacctttcagtgtcacaaagtagtgtcacatggttcggccccccgttgaaaaggctgaaaacaaggcgtttttgcgcgcgaatttactgcgtcagaccccctcagtgacactgtgacagtgacttcttttcctttaccggagaaaagtttttctgccttccaagaaaaatttctcgcgtatgagagaaggtactgtcactactgtcactactgtcacaaaatagggaaaagagtaggtagatcaatgacttgaatttgtgacagtaccttgtgacagtgaccgattcgcgcctcggagagcatggaaaatcgggtactgtcacaagaattgccttttttccgaatttccgtccatacggtaggaattttttccgtatgtgacagtacctagaaatccgaatttttcgcatccgtttcggtcgggcactatgtcaagctgggatgagtcgaatttccgccacgcgggcaataaaaagccccgggggatgagcccggggccggtgttgcggaaattccgaggaattaaatcgagttgcgtgggttgcgatcctcgacgcgctcgtcttccacgttcgagccgttgtcgccggcaccgggcggaaggtcgccgctctcgtagcggttcgcgtcggtgttgttctcgtcgacggtcgcattcggcaccatgccctgcggcttcgacgcgccgaagaattcgccggtctcgcgcgctgtgacctgcaagtcaccgtgcatcgtgatttcgaccgagcggccgggcgcatcgagcactgcatgcaccacgccctttccgtcgaccaactcgaccgccttgttgccgttgacgtgcgtgaacttcacggtagtcgtcatgtcgtttctcctgtgctcgggattgagcgtgttcgatcatacgctcgcagacgtgaaaaagcccggttgcccgggcttgttcgttcacaccttcagcgatgttacttcgatgtagtcgtcgatccactgctgaaggttcggccgcacgacgacatccggcgagcgtgaccaataccgcgcctgctttccattcgcaccgcgcgcgcggcccacgtacacgaagcccttcgaggtcaggaagttcgacaacttcggcccgtacggcacgccgacactgttgtccatcgcgaggtcacgcagcttcccgacgttgagcagcaggctcgtcacttccgggtcgcgcgactccgcgatcatctcttcgatttcgtcttcgtcgtcgccgcgcgcgaggtcgatcatgcgcgccttcgcgtcggtcatgggcgcatggccgtccgggtcgaactcaggatgcagcgggtagtcttccagccactcgcggatcgcgcccgggtggtaggcgattgcgttgaagatgtcgtcgtagtgatccgggttgcgcgcgcggaacttctcgatcatctgcttcgtctggaagtgggtcgagatgacgaagtagcggcggtcggcgtcgtacaccggcagcgcatcgctgtggttggtcaagatgatcgtcgaggtcacgttcggcacgttgtacgagtcgcggtgcatgcggcgaatcgaaaccacgtcgttcgtgatgaagggcttcagcttgtccatcaccgcgtagcgcgacgtaccgtggatgcgtgcctcttcgagcaccacgaccttgcgcgactcgaagaacgacgtgtacttctcttcgagcgcctgagcgttgacggtctcgacgttgttgcgcgacatgatcgccatgagcatttcaccgacgaagcccttgcctgcgccgtccacgccctgcatcacaaccgcccaacggattttcttgtccatgcgcttgatcgtgtaagccagccacgagagcaggatttcgcgctcgcgctcgatggggtacgaaatctcgaagtgacgcttcacggcttcgactgcgcgccgggccttgctgctcagcttgtcgggcaccggcacgatgtcttccgggttgaacttgttcgcgtgcttctggccgtcccactcgacgatgcggtctgcgccgggcaggtagacgtagccgctgacgaccggaacttggtacacgttgagcgcgagtgcggcggcctgttgctcaggcacggcttccatgttcgagcggtctttcttcgacagcaggaaacggttgttgcgcgcattgaacgcacgctcgctcagcgcgaggcggttgtccatgtagtagaactcttcctcggcgtcgacgtacaccacgtcgttgcaccaatgcggcagttccttgtagttgaagtcggagttgcggtagccctcgttgatcgccttgcggatcatcgcgatgggaaccttcttccccagctccgcgacgcgctccttaatcgcgccggccaacagctcgacttggaagtcgctttcgagcatgcggccccacttcgcagcaagcgggccaagcaactccatctcgctcgtcgtctcggcgaccttgcgcttgatcttctcgaactgttcctgcgagtgctcctgccgatgctccttcgccatcttgataagcgaggcggccgtcgtcaggttgcggcccatgtcgtcgtggaacgagttccacttgaactccaattcgtcggggtcgtagttgtgcgctggctccgaccactcgtgccacaacgtcaagccttcttcgttgccgtcgaattggtgatgcagcgccatgccgaccttcaaccactgctcgtagtcgtcggcaccgggaacccactgcagcacttcgcggagctggtcttcggtcaggttttccagcgggcgcttgtattccagcagtgcgttgtcgttctcgtcgtcgctgctgcgcgactcgctcggtgcgttgtgcttcttcaacgtccatccgcgacgctgcgcttcgagcttgaacaccgagaagagttcgtcgatgtgctcggtcgtgatttccggcagcatgtcggccggcacgctcagcgggttgagttccttgcccgaagtccacttgtacggcttcttggtgtcggggtggatgccgatgccgacgaactgctggccgtctgcgagcacttcgatggactgctcgtggccctcggtgtcgaggaacgtgatcttccgcttcgagaacggaatgtcagtgcgatacacgagcaacgtcttcggcgcacggccgacgcgcgtcatcgtcttgccgatgatttcctcggtgtgctcggccatgagcgccgccatgtcgtcatcggtgatgtcgatgtcgaccgcaggcgtgtgcttcgtgtggaagccgatgttgccctgcttgtagttgccgctcgcccacttgcgcacgagcttttcggtggcttggattttctgccactgcggttcaatcgggcctttccttcctgccgggattggcaagatggagtacccgttttccagcaattgagcgccgtacttacggagcacgctggtgatcggtcgtccagcagccataggtcactccgcgatgtcgtcgctaacaaggtcttcgaggttgaagccgatcttgcggttgaaatccttgtgcaagatcgtggccttgtcgcgcggcacaccgccgaggcgctgccaacgcgagacagtggtctcgtgccagttgtacttctcgcagattgcgttgagtcgaccgtacggcgggtcgagcatgagggcgatgcgccggagcagatagcgcactcgcgcatctgcgctatccagtgaatcaagggtagggtctcggcgcatgaattcctcgcagacattgggatttaaggggtctgctaagtcgatgagcatgcctattgacttagcatcgggacgggcgcatagtgcgctcgccgggcaggaattgcaatccacccgtcactcccaaaaccaacctagctaggagatacaaccgatgtcgaagctcaacgcgaagtcgctcgccgaagccattgccgccgctctcgcacccgtgctcgtcgccgccttcggcggtgccgcgaacaccagcgatgccggcgacgatgacggcgaggaagaagccgcaccgaagaagggtcgcggtcgtcccgccggcagcaccaacaaggccaagaccgaaaccaagccggcggccaagggcaagtccaagccgaaggacgaggaagaggaagaagaggaagacgacggcctcggtgacgacggcgacgacgacctcggcctcggcgacgaagacgaagaagtgacgcaggaagatgtcgtcaacgccttcaaggcgctgaaggccagcaagggcatcgacaagtgccgcgaagtgctcgcgaagctcgacgagtccaacgtgctgaacatcccgccgaagaagtacgccgaagcgctgaaggaaatcaaccgcgccggctcgaagaagtaattcggcctgcacgtcacacgaaacgcccgggttcgctcgggcgtttctttcggagagaaatacatgcccggttctcatgctcgcttcgcaccatcgtcggcgcatcgcatttacgattgcccggcaagcctgctgctcaacgagaacgagcccgaccgcgagatttacgaagcggccgaaggcaccgtggcgcatcacatcgcggaaatttgcgcacgcgcgcgccgcgagccggaagagtttctaggaatgacgttcgacagcggcgacctcgacgccgactacgacgaagagcagcattcctcgaaaggcttcgcgatcaccgtcgacgacgagatggtgcagggtgtcggggcatacctcgaccgcatcatgggtctgccgggcgaccactacgtcgagacgcgcgtcaacatctccccgtggtgcccgatccccgatcaattcggtacgtgcgatcacgccgcagcgtcgcacaagaagctcatcatcaccgacttgaagtacggccgcgtgcaggtcgatgcgccgcagaacaagcagctcgtgatgtacgcgctcggctttatcaacgagtacgactggctgtacgacttcgacgaagtaatcatccgcattgcgcaaccgcgtctcgatcacttcgacgtgtggatcaccagcaaggcggaactgctcgctatcggcgagaagatcaaggagcgcttcgcgctcgcgctgaagccgaacccgccgttcggcccgagcgagaaggcgtgccgcttctgcaaggtcaacttcaagtgccgcgcgaaccacgacttcctgtaccacgagcgcatcatgctgctcgatgacgacgacgaattcgtcgagcctgacctcatgctcatgagcgacgaggaaatcgcggcgctgtggctgcgcaagggcatgtacgagaaccgcatgcgtgcagtcgaagactacctgcacaagaaggtcgcggacggcgatttcgtgccgggcctgaagaccgtggcaggccgcagctcgcgctacttcgtcagtgaggtcgacgcggagctgctgctgctggaagccggtgtgcctgagtcgaagctgtactccaaacccgagttcgtgtcgcctgcgcaggccgaaaagctggtgcgcggcgaggcgaagaagaaattgcaggacttcatcaagtcgaagcccggcaaaccgtgtctggtctccgcagacgacaagcggaaagacctgactgttcagtcgctcgaattgctcgacgactgagcatcctgttgtacgaatgcgcgaaagcgaactacgaacgtcgaatgacgaaggagaaatcgaaatggcgaagaagaaagttggtgatctggtcgacaagggcaatgggcgttttctgctgaagaacgtgcgcctgagcttcccgtacttgttcgagcccgacgagcatgaagacgacaacggcaacaagaagaagtcgtatcgcgtcaccctgctgctcccgaaggcgacgcacaagcccgtcgcgcagaagctctcccgcctcatctccgagatgtgcgaggaagagtacggcaacccgaagctggcggccgaccgcaagttcctgcgtgatggtgacgagtcggatgtcgaagaccaccacggctgctggacggtgacggttcgcgagacccggaagccgatcctcgtcgaccgtgatcgtcagcctaccgaggaagacgacgagctgctgtacagcggcgcgtgggccaacgtggtgatccgcccgtgggctcagaacggcaagtccatgaagaagaagaacaagtacggcaagcgcatcaatgccggcttcgacatcgtgcagttcgtcgaccacgacgacaacctcgcgggcaatgctcgcccggatgtcgacgaggttctggacgaactcgaagatgacttcgaggacgatgacagcagcaccagccgcagcaagtccaagagcaagtcgaagggtcgttctcgcgacgaggacgatgacgatgacgggctcggcgacgacgatgacgacgacagcagctcgcgccgcagtcgctcgtcgaagagcaagaccagcagcaagagccgtcgctcgcgcgacgaggatgacgacgaagatgacgacgacctcggcatctaaaatcgggcatcggtaagcggtacctacggtcgcccgggcactccccgggcggctgtttttcagggatacggtatggacaagctgcatcacgacttcgagaccttcagcaagtgcgacctgaagaagcacggcttggcgcgatacgcgcgcgacaagtcgaccgaagtgctgttcctgtggtacgcattcaacgacgaagaaccggaagtctggttccccgcgacggagccgatgccgaagcgtctgcgccgcgctctcaaagacccgaacgtgcagaagtgcgcgcacaacgctcagttcgagcgcgcgatttggctgcacgttctcggcatcgacattcctatcgagcagttctattgctcgatggcgcacgcattctggctctcgctgcccggcaacctcgacgaactctcgggcgtgctgcgcctcggcgagaacgcgaagatgaaggaaggcaagtcgctcgttaaattcttctgcgggccgcgcaagccgaccaagaccaagcagtacacgcgcaacaccgagaagactgacccggcgaagtggaagacgttcgtcgagtacggccgccgcgacgtgatcgccgagcgcgctgccggtcgcaagctcgcgctcttcccgatgagcgacttcgagcgcaacctgtggtacatcgaccagcacatcaacgaacgcggcattccgttcgacaaggagttcgtcgagaccgcgctgcgcgtcatcgcgaaggagaagaagcgcctgctgggcgagatgggccgcatcaccggcctgagcaaccccggcagcggcacgcagttgctcccgtggctgcgcgagcgcggctacccgttcaccaacctcaaatcggcctcgatcaagaaggcccgagaggattgggattggaacatgaccgacgacgcgaatgcagtgctcgcgttgcacgccgaagcggcgcgctcgtcggtgacgaagttgcagaagatgctcgacatcgaagtcgacggagtgctgtgctacacgatgcagttcgcaggcgcgggacgtacggcgcgctgggccgggcgcgcggtgcaggtgcaaaatttgccccgccccctccgcgaactagaagaacaaggggcactgctcatggtgcgcgacgcgatcatgcgcgaagacatcgagttcgtgcgcctgctggtgtcgtcgccgatgggcgcgattgcatcgtgcatccgcactgcgatcaaagcgccgcccggctatgagtacgcaacctgcgacttggcctcgattgagtcggtcgtcatcgcgtggctgtcgggctgcgacaagttgatcgaggtctttcagaagaacctcgacgtgtacaaggtgttcgcatcgaagatgtacaaggtcgactacgagcaggtcgagaagtggatgcgtcaacacgcgaagcccggcgtgctcggcgcaggcttccgcctcagcggcggtatggagctgggcgagtaccccgaggtcatcaagaccggcctgtggggctacgcggagaacatgggtatcgagatgtcgcagaaggatgctgcggccgtcgtgaagttcttccgcgaggaatacaccgaaatcgtcgagctgtggtacgagctggaacgcgccgtcgcgaaggtgatgaacacgaaggagccggtgcgcgtcggcccgattctcatggacgtgaagggtccgttcctgcgcatgcgtctgccgtccggtcgctacctgcactacctgcgcccgaagatgatctggaaaaagatcaaggtcggcatcgacaagaagaccggcaagccgaagtacaagtcgaagaagggcttcacgtacgaaggctacaacacgaagaagaaatggacgcgcatcgactcgcacggcggcaagatcgtcgagaacttggtgcaggcaatcgcacgcgagttgctggccgccggtctgctgcgcgcatggaagtccgggctcgatgtccgcatgcacgtacacgacgaaatcgttgcgctggtcaagaagaagctgtcggacatctcggccgcaacgctcgaagagcagatggtcaagaagccgaagtggtggggcgaagatgttccgattcgcgcgaaggctgacgtagtggagtgctatcagaaatgacttggctaaccgactggcgaaacgtaatcaacggcaagccgccgcgcggcgacatcctgccgaccgacaaacatcgcgtcgaaaaggatgtggagcagaagtggtgcgccgttgcgaagcggcacggatggaaggcatacaagttctcgtcgcccggcaacagcagcgtccccgaccgcatgttcattcgcaacgggttcgtcttcttcatcgagttcaagcgccccggcggcaaggcgacggacaatcagctcgaagagcacaaggagctgcgacgcaaggggatgatcgtgtgggtcatcgactacttcgacaaagaattcgccgagtggatttttgaatgaaagaactactgaagcgctccgacctcgacgagtttcaaatcgctgccggcctgttcctcgaacgggtcggcagttgcgcgttgtggatcgacatgggcctcggcaagaccgtcgtcgtgcttacgcacgtctcggacaaggtgttctcgggcgagtggagccgcgtgctggtcgttggtccgccgctcgtcatctcggatacgtggtcgacggaagtaaagaattgggagcacacccgcttcctcgactatcaggaactcgacggcgacaccgagcacatgcgcatgcagttgcagcggccgtgcgaggtcgacggcatctcggtgcataagctcgggcgtctggcagcgttgttcaagcgcggcgataccgtgccgtgggacgcggttgtgttcgacgaatcgagcatgttccgcaacaagtcgtcaaagcgttggaagtacggcgtgcgcctgacgtgggggcaaccgaacgacgtgatcgagctgacgggtacgccgagcccgaacggcctgcatcaagtctggtcgcagattgcgatgatcgacggcggcgaga

SEQ ID NO: 18 - DNA, 56134 bp, Unknown
  Bacteriophage Xfas110
tcttgatgacttccgggtactcgcccacttcgccgccgccggagagacggaaacctgcgccgagcacgccgggcttcgcctgctgccgcatccacttctcaaccttctcgtaggggacgccgaacatgcgcgaggcgaacaccttgtagatttcgaggttcttctgaaacacctcgatcatcttctgacaatccgccagccagccaatcgtgaccgactcgatagacgacagatcgcaggtgacgaacatcttgcccttcggtgccttgatcgcggtgcggatgcacgacgcgattgcgcccatcggcgacgacacgaggatgcggacccaatccatgtcctcggccatgatcgcttctcgcaaaagaaggagctgccactgctcttccatctctcggagggggcggggcaaattttgcacctgcaccgcgcggccagcccagcgtgcagtgcggcctgcgcctgcgaactgcatcgtgtagcacagcatgccgtcgacttcgatgtcgagcatcttctgcaacttggtgacagacgaacgcgcggcctcggagtgcagcgcgagcacttcgttcgcttcgtcggtcatgttccaatcccaatcctcgcgagccttgcggatcgaggcggatttgagattggtgaacggatagccgcgctcgcgcagccagggtaggagctgcgtgccgctagtcgggttttcgaggcccgtgatgcgcttcatgatcttcgtgaggcgcgccttctccttcgagatgacgcgcagcgccgcttcgacgtatgccttgtcgaacggcacgccacgctcgttgatgtgctggtcgatagtccacaagcgctgctcgaacgcgctcatcgggaagcgggccatcttgcgtgcagcagcgcgctcggcgatcacgtcgcggcggccatagtcgaggaacttctgccacttcaccggatcggtgagcttggtgttgcgggtgtactgcttggtcttggtcggcttacgtggctggcagaagaacttcaccagcgccttgccctccttcatcttcgccgtcttgtcgtccaggcgcagcacggtggagagcgtatcgaggtcgccgggcagcgccagcgagaatgcgtgtgccatcgagcactcgaactgctcgacgggaatatcgatgtccagcacgtgcagccagatggcgcgctcgaactgcgcgttgtgcgcggccttcttgacacgtgggttcttcaacgcaaggcgcaggcgcttcggcatcatctgcgtcttcgggaaccatacctgcggctcttcgtcgtcgaacgcgtaccacaggaacagcacttcggtcgacctgtgcgtggcgtagcgtttgagaccgtgctttttcaggtcgcattcgctgaaggtctcgaagtcgtggtgcagcgtcgagtcgtattgaggcttttgcatgcgctggtctcagaaaaacggaagcccggggacaagccccgggcgaccgaagtagcactgtcaacccgaggaattacaggccgatgtcgtcgtcatcgtcttcgtcctcgtcgcgcgaacggcggcgggagttcgacggcttcttcgacgaggaacggcgcggacgctcttcctcttcttcctcttcatcctcttcgtcctcgtcacgagaacgacggctcgacttcgacggcttcttggaggaacggcgcgcggggcgttcgtcctcttcgtcctcgtcgacatccacgtcgtcgaaatcgtcgtccagctcgtcgagcacgtcgtccacgtcgggacgcattgcgccgccgagcggatcatcgtgcatcacgtgctggatgatgtcgaagccgcagttgatgcgcttgccgtacttgttcttcttcttcatcgacttgccgttctgcgcccaggggcgaatcacagcgttgacccacgcgccggaatagatcatttcatcttcttccatcaccggctgacggtcgcggtcgaccagcgtcgggcggcggctctcgcgaacgttgacgacccaatggccctcgtgctctgcgatgtcaccgtcgtcgccgtcgtgcaggaagcgcttgtcgctgcccaccttgccgccgtcgtactcttcggcgatgaggtcggcgatcaccttgtccaacttcttcttggtgcgtgcgccggtcgccttcgggatcagcaacgcggtgcggtaggacttggttttcttgccttcatcgttttcctgctcatcggggttgtgcaggtaggcgaacgaaaggcgagcgcctttcagaaggtagcgaccatcgcccttgtccacgaggtcgttctgcgggatttgcttcttagccacggtgttgctcctatcgttgtcgagactatcgtctgtcgagattgtcggttgtcgggattgtcgaactactacgtgcgtcagtcatcaaggagcgacaacttctgcacggtcaggtcttgccgcttgtcgtctgcggagaccagacacggtttgccgggcttcgatgcgatgaagtcctgcaatttcttcttcgcctcgccgcgcagcaacttctctgcggcgtggggcgaaataaactcgggcttagagtacagcttttcgggcttgatgccagcatcgaccatgagcatttcagcatcgagttcgctggtgaagtagcgcgacttcttgcctgcaaccaccttcaggccgggcacaaactcgtcgttggcgatcttggtgtgcaggtagtcggcgatagcgcccatgcgcttgtcgtacatgctcttacgcagccacaccgccgacagctcttcgaggctcatcatcgtgaggtcgtcttcaacgaagtccccgtcatcgtccagcagcatgacgcgctggtggtagaggaagtcgtggttggcgcggcacttgtactgcaccttgcagaaccggcacgccttctcgctcgggccgaacggcgggttcttgctgagcgccagggcgaagcgcttcttgatcttctcgccgatagccagcagctcggccttgctcgtgacccacgtgctgaagttctcgacgcgcggctgcgcaatgcggatgaccacttcgtcgaagtcgtacagccagtcccactcgttgatgaagccgagcgcgtacatgatgagctggaagttgttctccggctcgacgaagatacggccgtacttgaagtcggtgacgaccagcttcttgtacatggccgctgcgtggtcgcacgtgccgaactgatcggggatcgggcaccaccgcgagatgttcactcgctgctcaacgaagtggcaccccggcagacgcatcacgtaatcgagatactgaccgacgccagcaaccatctcgtcgtcaacagtgatagcgaagcctttcgaggaatgaagctcttcgtcgtagtcggcatcaaggttgccgctatcgaacaccattcctagaaactcttccgggtctttgccggtcaacaggcaggtctcgccgatgtgatgcgcaacggtgccttcggccgcctcgtagttctcgctgtccggctcctgctcgttgagcaccaagctggccgggcagtcgaagatgcgctgtgcagacgacggcgcaaagcgcgcatgcgcacgcactgcttccttgacggcctttgcgagtttgttgcgacgtggcttcatcgtgtcctctcgaaagaacgcccggcatcgccgggcgtccgtgttacgtgcaggccgaattacttcttgcggctggccgcgcgcttgatttccttcatcgcttccgggtacttcttggccggaatgttcaggacgttgctctcgtcgagcagggccagcaccttcttgcaggcgtcgacgccgtggctggacttcagcgccttgaaggaggcgaccagctcttcctgggtcacttcttcttcgtcgtcttccaggccgaggtcgtcgtcgccttcgtcctcgtcgccgtcaccttcttcttcgtcttcgtcgtccagcgggtcgggcttcgacttgcccttgcccttcggagcggccttctcggccggtgccttcttggtgctgcccgccgggcggccgcgaccgcgcttcggcgcttcttcttcgtcaccaccgtcttcggattcgttgacggagctgttgctgctggtcccgcccacggcttcgatgatgagaacgatggcggcggcgagcttcttcgcgttgatggtggacatcggtttgttgctcctagctaggttggttttgggagtgacgggcggattgcaattcctgcccggcgagcgcactatgcgcccgtcccaacgctaagtcaataggcacgcaaagcggcttagcagaccccttgaaacccacacgccgcgaggattccatgcgccgagacctaacccttgattcactggacagcgccgacgcgcgcgtccgctatctactccggcgcatcgccctaatgctcgacccgccgtacggtcggctcaacgcaatctgcgagaagtacaactggcacgagaccaccgtgtcgcgttggcaacgtctcggatgcgtgccgcgcgacaaggcttcgatcttgcacaaagacttcaaccgtgagattggattcaatctcgaagacctcgttggcgacgacatcgcggagtgacgcacatggctggacgaccgatcaccagcgtgcttcgcaaatacggcgcgcagttgctcgaaaacggctactccatcatcccgattccgaagggacggaaaggcccaatcgagccgaagtggcagcatattgaagcaacgccgaagctggtaaagaagtgggcgagcggcgactacacgcagggcaacatcggcttcttgacgaagcacacgcctgccgtggacatcgacatctacgacgccgagatggccgagttgatggccgagcacgcgcttgaaatctgcggcaagacgatgacgcgtgtcggcatggccccgaagaccatgctcgtgtaccgcaccgacatcccgttccagaagcgcaagatcaccttcgtcgacgaagaaggtaccgagcacgcaatcgaagtcctgggcgacggccagcagtttgttggcatcggcctgcacccggagacgaagaagccgtaccgctggacttccggcaagggcatgaacccggtgagcgtgccgcacgacatgctgccggaaatcacgaccgacgccatcgacgagttgttctcggtcttcaagctcgaagcgcagcgtcgcggctggacgttgaagaagcacaacgcaccgcgcgatgcgagtcgcgacgacatcgacgacgagaacgaccgcgcactgctggcgcacaagcagccgctcgaaaacctgaccgccgatcagctccgcgaggtgctgcaatgggtgccgggtgctgacgactacgagcagtggttgaaggtcggcatggcgctgcaccatcaattcgacggcgaggaagagggcctgtcgctctggcacgagtggtccgaaacgtcgagcgaatacgacgccgactcgctggaagaaaagtggaacacgttccacgatgagatgggccggaacatcaccacggccgcatcgctcatcaagatcgcgaaggagcaccggcaggaggtcgccgaggaacagttcgagaagatcaagcgcaaggtacatgagaccgaaagcgcgatggaacttcttggcccgctggcgaagaagtggggccggttgatggagcacgactatcaggccgagctgctggtgggcgaaatccagaagcgcgtcaaggagctgaccggcaagtcgccgagcatcgcgaccgtacgcaaggcggtgaacgagggctaccgcaattccgacttcaactacaaggagctgccgttctggtgcaacgacgtggtgtacgtcgacaccgaggaagagttcttcttgatggagaaccgcgtcgcgctgagcgagcgtgcgttcaacgcgcgcaacaaccgccacctgctgtcgaagaaggatcgctcgaacatggacgcggtgccggagcagcaggcatcggccctggcgctcaacgtgtatcaggttccggtcgtgagcggctacgtgtacctgcccggtgccgagcgaatcgttgaatggaatgaccagaagcacgtcaacctgttcaacccggaagacatcgtgccgatccccgagaagatgggcggcaaggcgcggcgtgcggtcgaggcggtgaagcgtcacttcgagatttcctacccgatccagcgcgagcgcgagctgctgctgtcctggctggcgttcactatcaagcgcatggacaagaagattcgctgggccgtggtgatgcagggtatcgacggtgccggtaagggtttcgtcggcgaaatgctcatggcgatcctgtcgaagaacaacgtcatcaccgtcaacgcgcaacgcctggaagagaagtacaccgagttctacgagcgcaacaaggtcgtcgtgttcgaggaagcccgcatcgccggtacgtcgcgctacgccgtgatggacaagctgaagccctacatcacgaacgacgtggtggacatccgcaagatgcacagcggcggcttcaacgtgccgaacgtcagctccacgatcatcctgaccaatcacagcgacgcgctgccggtgtacgacgccgaccgccggtacttcgtggtctcgactcacttccagacgaagcagatgatcgagaagttccgcgcgcagcaccccgaccactacgacgacatcttcaacgccatcgcctatcacgcgggcgcgctgcgcgagtggctggaagactacccgctgcatcccgagttcgacccggacggccacgcgccgatgacggacgccaaggaacgcatgatcgacctggctcgcggcgacgacgaagacgagctgctggaaatcatcaacgagagcaccgacccggaagtcaacaacatgctgctcaacgtcggcaggctgcgcgacgcggcgctggatgcgtcgtgcggagttccgttcgggccgaagctgtcgaacttcctgaccgccaagggcttcgtctacgttggccgggcgcgcggtgcgagcggcaagctggcgcgctattggtcgaagcatcccgagctggtgatgaagccgaacctgcaagcctggatcaccgacttcatcgaactcgcacgcatcaagatgtaacctacaaccgcccaatccagggcacaggagaaacgcaatgaccaccaccgtcaaactctcgtacgtccacggtaacaaggcgctcgccgtcaagctcgaaggcaacagcgtcggcgaactcggcccgggccgcagcatcgaagtgagcctgcactcgggccagcagctcaccatcgacgagaccggagagttcttcggcagcaccaagtcggaagtgcagcagccccaggccaccgtagacgaagccacgaccgacgccgctgcgtacgaaggccgccgcgatctgccgccgggcgctggcgaacccggctcgaacgtgccggacacccgcgtcgaataaacgcacaccggcagcgaggcaaaaagaaacccccgggtcgccccgggggtttttcgttgcgccgaattagccgactcgatcctgccatgccgggtccggcttggcctcaatgcgcaatttccacccgaaccacatcgcggcaatttccggccgccggtacgcgcctttctttttccgttccagcagggtcgccttgtcggccactcctttttttcagcagcagggtgcggctgatctgcgacacgaaatatttcttgtagacggcttcctcgaagtcagcgcgcgtgctctcaatttcgtcggtttcagcgatcatcggcatttctcggtgtgccggacgaatttccggcgaattaattatcggcaattctttccaatcgcgcaaggtactgtcacaagcccgggaattaactccttgtgacactgacgaattaatttgggccgatgtggcgaaaaaagcgtcactgtcacaaggtactgtcacaagccgaaacccttgtcctgcctacttttcctcttattttgtgacagtagtgacagtagtgacagtaccttctgctacacgcaggaatacgaattgtccctcaaatattagcaatggtactaatttgtggccgtttttcgtgttttctttcccggtaagggagaaggtttcagtgtcacagtgtcacaaaggcccaactcgcagtagcaaatcgacctcaaaacccttccaaatcaaccgtttgcgcggggggccgagttgtgacagtaccgcaaatcgtcagtgtcactactgtcacaagcgaataaattaattcctagcccggaaatgcggtgcagcgcgcggttcggccccttataggagacggaaatgcgaaaaaattgaaaaatgcgcgagcaccggggtcagcgccccccgcgacgcccgcgccagggccggaagtacctttttactcgcatcgccgctatcccttttaccctcctgcgccgccgcaatgcgtgcgtgcgggccgcgcggccatgcggtgatgcgaataaaagggaaataaatgcaatgcgcacacgcacgcgcacacgcgcctctaggcccatgcaataaattaaatgcgtgcaatgcgggaaatgcccaggtgcagggctatcgggtgtgccgcaggtcgaccacaaatcagcaggacgtgcgcccaggtgcaggccgttagcgagtcagcaggacgtgcgcaatgcggaaatgcgcaaatgcgggcgcgcaggtgtgctcactgcgcaggccatagcgttaccagggaaaggcgcgcccaagggtaggcggccagggcgagcgcccagggacagacgaacgcgcaataaaaagcccccgcgtgagcgagggctagacagtggcagacgtgggggtgtgggggtgcggggttttattcgtgtggcttgtgccgggcttcgatgtcccgcacctgcgccgcgtagctgcggccgtgtggcttgacgtgccacgcgcaggccacgcccagggcaagcaccacggcggcggtgatcgcaccggccttgtgccacgcctgcactgccagcggcaggacaagcgcgcccaggatcgccaggaacgcaacccactgcacaaggcgcagcagactatcggccagaatgtttgcgcggatgattttgcgcttttcggtttcggtcagtggttccagggtcatgcgtcaatcctccttcaccacgcgcacaaccggcgtcgtgtccaggccatacacggccacgccgcgcgaggtcgacaccttgacgcccaggcggcgcgcggtgagcgctagcgacgtgtcgcgttcgtgcggcccttcagccacgaatacgcgcgccttggggtcagtgctgcgcagccaatacgtgtagggcgtcacgcctgcggccctcccgtgtagtgctgcacacgcaccggcagatgcggatattccgcctgcaaccgttcggcgtgctccaccgctggccccttgtcggcgtaggccgcagcagtcgaccaattttcagtcggcttgaactgcaccgcccaggggaagttagcgcggcccgggcttttgacaatgcgaacgctcacgggcgcgtctccttaaacagttcgggcgcggcgtctgcctcatcgcccacgccatgcgcataagcgcgcaggcgagacacggccacgcggtcggcgtcgcgcagtcgctcgaactgacccgcccgcacttgcgcatcatcgttgcgcaggatgtcggcgcagcggtcggccagggtgtgacacatgacggcaaacggcattggcgcgaacgtggcgctatccagggcggcgcacgtttccacggcgaaggcgaacccctccaattcctttgcgcggttgtgcctgccgcgctcgcggtggatgagggcctgcgcacgcatggcgagggcgagacgttccagggaatcggccatgtcggtcactccttttcgcagcgcaaaggcgcgccggggttgtctaccagggcttgcacgcaatcgcctgcggtcaggccgctatccatgacgaacgtgtgccgctcgccgcccaggatcaacaccaacacaagggagaaagtcatcattagcgcacctcgaacgtaacgcgggggtagctcttgcgcgcttcttcctttgcctcgcgttgcgttgcgaagcggtcgacgcggccagtgttgtgcagcagcaaccacggcgtttccggcgtgtagccgtctgcggccttatgcatgcggttgattgaggcgacgtgttcgccatgcgacaggacgttcatgcggtgcgctcctcgtggatacggcggcccatgtcgataatcgcccatgcggttttttcgtcaatgtcgtgatgcgcggcgaaacgtgcaaccgtcaaaaacgcattgaggtattccaggtaagcggcctgcaacgcgtcgcgcaggtaaccgtgggcggggttgtcgatattcattccttcaccctccacgaacgcgaaccgctcatgtacaccgcgccgtcgccgccatacagcatggccgaaatgccgtgcatcacgttgtccacgcaatcgctcgcaacggtggccgcgtagtcgccattatcgtccacaccccacagcgaatccgtcgcgtccgtttcgttgccttcgatgtccagcaacgtcaccacgacgccgatatagctccattcgtcattgcaccatgcgcgaaggtgttcgtaatcctcgcgagcggcgagcgcggcaatctggcgcttactcatgccctcttcagcgccacgcgcgccccagccgtcgcgcagcgcgatgcggcacgcgtcggcgaagtcataaaagcgtttgctaccgtgatcggtgttcaacaccaattcgcccggcgacttgtcgcgcgtagtccagtcggacacggtgccgtgaccatcttcgttttcccagggtgcgccgttgtcggtgtcggcgcagtgatcgacgcggaacgtaaggccgtcgcgttccagggtataggagtggataacgtcgctcatgattacatgccctcgaacagttcgtgaagctcgcccatcgccttatcgccgaacgcggcgcgcatcttcagcgcatcggccatgcacgcgtcatagatagcgcgcgccttgatgctgtcggaatcaaatccgtaatcactcgcccaatcggcgaagtcgcggcaatccaacacgcgcgagtcggacaggaggctataaaacacgtccaccaattccggctctagcttgcggccgcgcttgaactggccgcccatcattccgcccttcgcctcgaaccccgtatcgcattcctgcgcaatggcggcgcgcttttcggttttcgggttgacggtcggcgtgttgaaattgttgcgctgttccgccgggcagtgcccgcaaccttgcatgtaatccgtcgtcaacacttcgcggtcgcccttcttcagcgtcacgcgccagttaagcgacggcgatttttcatctttgttgcgcgacgcgtgaaacggcacaaactcggcgctcatggtcacgcccatctgttccaggatgaaagcgcgatcatcgcttagttcatcgtaacgcgagccttcgccgggcatgtcgtcgtcataggcgggcgcgtagtgatactgaagcgcgcacaactcgccgtctttgcaaagcgaatcggtgtagtcgttccacgattcggccagggccgggccgtcatccttcggaatgtcggcggctaactcctgccactgtgcgaacgcttgggaaagggaaatggtcatgtgtgcgattccttagacgggggtgacggtgataaagcggggcgggcgcacggtgtagccgtgcaagcccagggcgtaattgcgagcggtgcggcggtcatcggcgtggacggtgaacaccggcacgccagggagcgagataaggaaagcgcgcattagatgaactcccggacaagggccgcgacgcgcggcgcgtagtgataggcggctgcggcgacgacaacccacgccagccagcccaggacgcgcgacacggggagcgaggcgcgaggcttgcgcaccggacgcggtgcggtgctgcgcgcagcggacaggcccgcgtgcgcgtcatagtcggagcgactgcggcggctcatgcctgcaccagggcgttaacggcgtcgccagcggccaggatcacgccagcacgattgaggcacgctttcgtgagcatgccgtcggcgtccgtcgtgatgctcacggtgttgttctggatgatcgccagataggcataaccgcacaccttcgccattgcagcgtcggcgatgccggattcatcggcggcaccgaacacgcccaggaacgggcgacgctgcgccagggtgtcacgggccagcgccatagcacggtcggcggctgcgcgaatctccgtatcggtgacaggggtagcgatgtcgtgggccagcttggcaaccacgttgcgaaccgcgccgccttcgcgcacgtcgtcggtggcgaactgcgcggacagtgcgaaagcggcggcgctgtcgcgttccatccgcatgcgcggggtgacgccggtaaagcgcggttcgtcgtcgcgcttcataccctgatcccagccagcggcaaggcgggtgcgctgttcgatgatcgaatcagccagggcggcggcttcgcgaatggcggcggtgcggttcgttgcgttcatggttgctttccctttgttagttgccggggcggtgttgcctgccggtggaagaattacagcacccctcgcgcagtagtgcaaatactttttttcaattatttttctgaacggcgttcagcgcttcccaggatgagcgacgcggccaggagaacgaaccgcgcgcggcgcgcgttcattgacacgcgcccgcaggtgaggcgcgtgacctgtgcaggagcgcgggcgggtgtgcgtgcaggtgcgtgcgcgcgtccgcgtacacgtatgcctccggtacagaaaaagcccccgcttcggaaagtcagcccgttccaaaaatccacggcaggccgaaaccgaactcgaaagccagcgcgctctcgcttcggagacccagccggacccaatttttctcccgcttcggaaacccagccggacctttgtgcagcagggcggccagctcccggccggtcacgaccgagaaccgggcgcttgacaactgcccccggccgcgcagtagtatttgtcctgtccctttactccaaccacggcacaggagattcgcccgatggcatccgccagcaccaccagcacgaccgcccccaagaagccgcgcaagatgccgaccaccgtcaagaaggaacttgcggccaagcggaagagcaccgccgccaagccgaaggtcgccaagccgcgcgtcctgttcctgcccggctcgctcaacgaccagatcagcaagctcaaagtcggcgagtcgctgggccacgtgcgtcgattcgtagtagagaacggccccacgctgtcgtcccaggcgcaatcgttcttcaaggcgaagaactcggtgctgtccggcggcatcgccaaggtgcgcagcgcacccgagcacgcaagcaagcgcttcacgatggaacgcggctcgtacatgacggccagcaacgacgccatgttcgcgttcctgaccatcactcgcaccgagtaacggccatgcgcaagtacaccgtgatggaattggagaagggcaaaatgttggcccaaagggtttcggtttttcagaatgcccgagtaccccctttgtctcgcgcgcgtgctgccaccaccctactgctcgctgcaatccgtctggccgcatggcaacgcatgcgcctgctctcccgctggctccgcgacaagcaggtgtgcccggcgtgcgagggagccacgcagctccgcgacaactacatccgcatctgcatgctgtgccacggtcagggtgaagtgacgtggcgcgaggtcgaggcgcagaagtggggcgcagcactcaaccgctacatcgagcagaacaaactggatcacagctacttctggcccaggctgacgctcaacgacctccactggcacgtcaacggctggatgtcgcttgacgattgggacgaagagttgctgggcatggccgacctgcaactcgaccgcgaagccgcaggccacgtaagcaccacctaacccaaccaaggaccgccgatatgtacgataagcagttcaccaacaacgcaccgaagccggtgcttctgcccctcatcgctacctgcaacgacgagggcattgtcttctctatccaccgccgacgcggctaccacatcggcctggatgacggtcaaatggccgaggctgagcgcatgttccagtgggccaaagtcacgttcaccggccaggacatcgtgatgttccaatcgcacaacggcgtcgtgccgtcgccgcagccgggcttccactccggcggctttacttctagcttcggtcagggcaagagcgaagcggcgttccgagccacgtcggggcgcgacctgttcccgggcactcagctccacatgctttccggcagcatagacttcctgaaggacaatgaccgtcgctatatcgtgctcgacgacatcgacccgcacgccatcgctgaagccatgctgctctcgccgggcattctcgacctgctgcgcgtcgacctgctggacatcgaagcgcgcacaggcaagaaggaagtcaacatcgagctgcgcgtcgacactggcgacgtgatcggcgacctcgaaaagtgggccaagaaggtcggcatggagagcttcgaccaacgtgtctactcgaagaactacaacgaaggcccggcgttctcgatcaactcctactggcagagccgcactgagccgacgaagttctaccgcgtgaccggcttgcagcagtgcgtgcgccactggcatgtcgagatgcactgcttgcaggacggcgagccggaagatcgtgtgtgggaaagcacgcgctcgtgggctgacctcttcacccctgtcgaccgcgagaccgccctggctccgctgtcgccgcagagcagcgtcggcccgtacgcgtaccagctcgacgcccaggcgttcctgcggtcggagcgcgcgagcggtgtcgaggctgagtttgtcgctgaagccgaagcgccgaggaacgttgtcgacgccacgcagcaggtgcttgacggcgtgcccttccacggcaatgagctgccgccgaaggtcggcgagcagtaccagcgcgtcggcagcgagcacatctacacggtggtcgacgtgcagcagggggacttcaacacgcacacggtgacgctggacacgcataagggcggcgtccactacggtcgcaacaagcacactttccgcgatcatgcacagtggctcgcgaaatggcgtccgctcgatagtgagggcaacgtcaagccggttgtctacatcgacatcgagaacgacaacggcgcggtgatgcaggaagtccgcgaagacatgctgacgcacaatgagggcgagaacgcggtgcgttggattcgcgtcatcggccgcgagctggaccgtcgtgtgccgggttggcgcgactacgatccgccgggcgtgctgtacgacgactgcgcgctcatcatccgtgccatccgcacgctgttccgtggcggcgtgcaggtcgaatccgagctgattgccttcaaggattcgctgaaggaagtcgaagccctcgcggagcagcgcctcgccaacgtcgagaagcgggaccagcgcatccggcagatggaaggttggatcggtgagatgtcccgtgacgcctcgcgtgcattcaggaacacgttcggccgggataagggcctcgaagtgatgaaggagatgctgaaggagttcggccatgcttcgctgctgtcgatccctatcgaggatcgcgtgagctgggtgcgcaagttgagcgagtacacggcaaaggcgggcatcccgtgaaggtgcaatacgaagaaatcggcgatccgactgaaacgggggtctacgcagtccgcgtagatcaccccaaggtcgtgaacctcgtcgtcgacgcgttcctcgtgtggtacgagggccattggtactacctgggaagcgaccagcagcatcgcggtgaagtccacggttgggtcggcccgctgccccgcatccgcccgctgcgcacaaacgtggagctgccgtaatgctcgaactcgaagccttggaagacgtgaccgaagccggtttctacatcgtgcaggtttgcgactacccgacgatcaacagcaagcgacgcgcgtaccacgtcttcgagttcaacgaccgcttcgggtggttcgagacgctgcacaagtcgcgcacctacactcagatttacgggtggtacgggccgctctcgctgaacgacatggaagtgctcgacgacccgagcgagatgggctactacgcggtgctgttgcaaccgtggccgggccagtcgccgcactacaagcagttccgcgtctgtgtgtggcgtcgcgacgcttggcacgatcagtacgggttcgccaagcagtacggcaacgttatcggttggctcggcccgttcccgttcctgccggagacgcattggctgaagcaacacgagaaggaagaagcggaggacatcgggctgtgagtttccgtccatccaccggccgtaagatcacggtaaagaagaacccgaagaccacgcgcgacatcatgcgtcggcacctgcgggaagagggcaagcgaatcgtcgacttgtgtgacgtgtgggacatgcacccgaacagcgcgtaccgcaggttctacgacaagcgcccaatgacgccgcagatgatcgatgctttcgtgacgctgctgaagctcgaccacgaggacgcgagcgagctgcggctcttcgctgcaatcgaagcgggctggcagctcgaccacctgaaggaaaaggccgcatgaagtacaagcgcatccagccataccgcgacgtgttcattgccgagctgcacagcgagcaggtgcgcagcgacggcggcccgctgatcgtgctcgacggagtgggcgtgcatgtcgcctactacatcgtcgacgagttcggcgaagtgctgcatccgatccagggctatttcatctcgccccaggtcgcaatcggtgccgccgacatcctgctcgacacgccgaaaaagttcggccccaaggtttcggctctcatccgggccgagaaagatttccacaaggagttttgacatgaacgaccactacgctggactcgcaggtcgggtcagctttgagaacgtggcgggtgcccctatcagcgtcatttcgggctacaccgtcgaagccgtccgcgacatgtcgcccggcgactggaagacggcactggcacgcaagatcgacggcatcaagaagggcgagcgcgccaccatcaacgaagtgtggaacaacatggagggcacgtgggtgagcatccgcatgtctgacggtcggaatatcgacgtgagggcggctggtctgaagctcatcacgcccgagatgctggaaatcgaaaagcaggagaaggaagaggccgacgaaagcaacgcgatgctgttccaggcttgcacctatcaggccaagcagggcgacgactggcggatcggcatcgcacgcgtgaagtgtttcggcgtttccgacgtgtcgtggatcgtcgacgcggccacgggcgagaagcacaagagcatgtgggactaccgcctgacggaaggcgcgtgcaagcacatcacgacgagggttctgtgatgcgagtcgacatcacgtttaacggagcgccgccgctgatcttccgcaacgccaagagctgcacgttcgaccagggttgggtccacgtcaccgaccagaacgacggcgagcattctttccccgcccacgacatccgcgttgtcgaaaagacgccgacgcgccgctactaggagaaacaccatgagcgacatgcaaaccacggacgacctcatcgcgatcatccgccagcgcgccgaggcagggctgaagaagtatggcgtgagcctggaccgcaaagacctcacggcggcacagtggttgcggcatctgctcgaagagctgtgcgacggtgcggggtacgtgctggcggccgaacgcaaagcagtcgagaccgaaaccgcgatccgcgccgccatccagttgctcgtgctcggcgacgcccagggcgcggccgacgtgctcgccgcatgcctgcctgacggggacgccgatggtgagcctgtcgtgctgatccgagacgcaggcggcgcatgagtgaccgcaactacgcggccatgcgcgccgccgcacgtgacccgccgcaggcgtgcatgcatgccgccgccaccgcagacccgtacttcaacgagagctttccaatgcccctcccgccgcccgagaagcgccgctacgaacacatggctccttaccggggctacaccatcgcgacgtacaaggacatgctcgatgagccggtctacaccgttgagggcgtgccgatcttcgcggtgtacttcgcgctcgatgagttcggcgactccatcacgccggtcgatacctgcttctggtcgccgttcctggcccgcgcgatgatcgacatctacgtcggcatgaccgagggcgaacgcaagacgtggtggaagcggcaaggcgcgtggccgatgatccaccagaactacagctcgcaacaccacctgccgatgctgctcgacgtaatgcgcggcatcgcagcggagtgctccgaccctgacctcgacatcctgttcggcgatgcgagcgagttcggcaagcacgtggaaaagcgcatcaaacagggtctcgacaccctgcacatctcacccaaaccggagtaactgcaatgcccaaatatcgcatcgtgaaagacggccgccacgttggtgacatcgaagccgaggacgcgcggcaggctggcccgctggccgccgagaagtggggcgacggcatgtacgacctgtcgctgatccgcgaagtcgaagacgacgaagaggccgagtgatggacgcggcgacggcgctctggattctctcgaacctcacgctgttcgcagccctggtcgcggagaagcatcgcaaccggaagtaccgtgaggcgatccacgggttgctcgcggacgagggctacgtcgaaggcgagccgcaggcgtacatcaacgagacgctgcgcatgacggagcacatcggcaacccggaaccgagtgctcacgacttcgcgcacgccctggtcggccagaaggggttccgcaaggccatcgcacacgaagagctgcatcgtgtgtacctcgaaacgtacggacggggcgcacgcaatgggtgaactgccgcgcgtggggacggtcaggctctaccggatcgacggcgaagagatgaccttcgaccagattcaacgcaactgcccgcacgtcacggaaaagatgctgcgggaccggctgttccgaggggagcgaaagatggcccggctgagccgtccgccggattcgcggaggggtgttgacaagccccggagctggcgatagagtggccccgcagtagcgattttacttcggactccccaccgggtaagatcgagctgcaacgagacgggccgaggccagtctcccggtagcacggaagcgcgccccctcgcgacgaagtgcaaacccggcgtccggtgccacgatacggcaccccataattctcacgccgagagacaacatgaaaatcgaaatgcaagacctgccgaaagtccgcgacgcgctcgacaagttgatcctcgatcagcacaactaccgcaacctcaccacgcacggcgaaccggaagacaagctgcgcgtcgtcggcgagggcggccaccacgagggcgagctgacccgcgaagagctggccgaaatcttcgagaagcgtatcgaggaaaatctgaagttcctccgtcagcgctaccagatcgacttcgcccccgcgccgcagctcgtcactcgtgcggttccggctccgaccggcggcctgaccgaagccaacgaaaacgatctggacgccgaatgaactaccccgtcatcccgaggatcgcacccatgactgcaccgaaagtctcgcgtcgcttctacaacgcgctgcgcctgctcggcctctggttcctgttcgtcgccgcgttcaagcagtacgcgcgcttcatcaagccgagccgcgtcatcaccctggatggcgtcaacggcggcgagcgtcgaccctacctgacccgctggcacctgatcccgcgcaaccgctggctcaacctgtacctgcacaagttcgtccacggtgacgacgagcgcgctctgcacgaccacccgtgggccagcgcctcgctcattctcgaaggccgctacatcgagcacacgagcgagtggttccctgcgttcgataacaagcagatgggcgcgtacgtgatggcgatgagcgacctgttctcgccgcaggacggccgcacatacgtcgagggcagcgtgaccgtgaacagcggcttgcgcgaaggcgagaaccgcttcgactacacccagcagttccacgctggcgacttccgcaagctgccgccgacgcacatgcacatgatcgagctgttcggcaacaacaccgagccgtgctggacgctgttcatgaccggctcgattgtccgccgctggggctttgcctgcaaagacggctggcgcgacttcaaggaatacctgcaagacagcccctcgcaccctggctccacgctgggctgcgagtaaccgaatcccgcaagggaaccctgctcgcatcccgcgagttgtcgacaacaacgcaatggagatacccgatgagcgccaccgctgaagcagtgaccgaagcaaccaagaaggcggcgaagaaagcccccgccaagaagaccgcaccgaagaagaccaaggccaccggcacggccgctgccaagccgcgtgccaagaagctgatcgccgccaagaaggccgtcaagaaggctgcgccgaagaaggtcgccgccgatgctccgaagcgcggccgcccgccgggcaagaaggctgcgaagaagaccggcgtgcgccggggcaagaagggcgcgaagcagttcgcctacctgctgctgaccgcgcaggaagacggcacgcagaaggcaggcggcatgcagggtccgttcatcaccgaagccggtgccctggaagacgcgagcatcatggccgacgacaacacgaccatcgtgctgttccgtgagaccaagcgcggcaaggtgcagaagcagaccaagttcgtcgccggtcgctaagtcggccttgaccgagtagtacaacgagcggccctgtcgaataccggccgggtcgctttttcatatccgcagcaaggacactcatgaaagccgacatcaatatcaaccgcagcctgcgtcgcgtgttccgcacgtacgacaaggagaagcagctcgaagcgcaggggaaggaactcagcccgtggcgcaagaagcagctcgcggcagacgagcgccgcttgttcgagttgcagcagcgcgacaacgagaccgacaatcgcgccgacaagcgcggagtgccgggcaagccgggcaccggcatcttcgccacccgcgacaagggcagcgtcgaagagaagctgcgcaaggcgttcggcggcaaggtcgccaagcgcatcttgcagcgtgagcgactggccgctcgcgagcgccccgaccacgtgcgcatcttcgtcgagcaggtagtcgacggcgtaggctcgcgtacggagctgacgcgcggtgtcgacttcgcggttgtcccgccgccgcacggcgagccgacgctggtgctgcacgacgacgcgaaggtgttcgagattgagtacgcctccgactttccccacaccctgacctgagagacccacatgagcactctttctctgaagcgggaagaccgactggccttcgtcaacgccgcccacgcagcggccgcaggctacgccgagttcaccgagaccaccgcgaagtatccgaccacgctcagcaccgttgcgatcactgcgggcgtcctgtacgtcgccctgggcatcggcaacgaggtcggcgaactggccgaactgttcgacgaagaagcggtcaagcccgactaccgcgccgaccgatacgcgaaggcgtggaaggagctgggcgacgtgcagtggtacatcgcccgcatgtgcgaagagcagaagggcctgccgccgttcgccatcatggtgcgcaacgcagccacgcgcctcgccgacgcgcactaccgcgaagcccggatcagtggcttcgatctgcaatcggcgctctgcactcacgcgggcatcgtccagggtgtcgtcaagaaggccatgcgcgacggcatgcagtgggacgaggccaaggccgccgcgaagctggaagaaatgcggcaggcattgcagcagatggtcaacgtctcgttcgagttcgccgagcgcaccgcacccctggtcgactgcggcagcggcggctacgtggcgttgctgaagggcaaccgcgacaagctggccgaccgcaaggagcgcggcgtgctgcatggggacgggggcgagcgatgagcgcgcgggcgtatttcatcggcggccccttggacggccagcgcctcctgttcccggcctcgccgccgcagctctactcgcatgaagtcaagcaggaagagctgcctgtcggcgatccgaccccctcgcaccggttcgagtacgagaagcacttcttcatggatgcgatggacagcaccaccgtccatttctacgtgccgctgggcaagggcgcatcggccatgcgcgatttgctcgaagcgcggctgaaggagaacgccgatgggtgagtaccacgacctgacgatcatgctgagcctgccgcgcagtcgcagcgcgtggatggaagcgttcgtccgcccgggcaccggccacggctgcgcgtctctgcacaacccgttgcagcagtgcgcgtctatcaacgagctgggcctggttgttgacggcatgccgcccggcccggctttcatctccgacgtggccgcgatgttctttttcgaccatctcgtcgtgcggttccctggcgcaaagttcctgatcgtccatcggcctgcgcgcgaagtggcgcacagcatggagaccctgggcatcacgccgccgctcgatctgcgaaaggccgagaagcagctcatcgaaatcgccagcagcatccgtcacaacccctgggtgcttaccggcagtttcttcgagctgcataacccgtcgctgctctcggccatctacaagttcgtcaccgggaaggtcgtagagccgcgccacctgcacgcgatgatgaagaccaacgtgcaggtctcgctcgaagaacaaatccggcgcactgacatccagaagcagcgcatcctgttcggcaaggccaagatcatccactaggaggcaccatgaaaaccatcggcagcttcgcaggcccgtatcgcttcctctcgaacttctggtcgtgcgctgtcgttttcgacggccactcctaccggacggtcgagcacgcgttccaggctgcaaagaccgacgacatggacgaacgtcgacgcatccgtaacgagccggacgccgcaggcgcgaagcggcgcggtaagcgcgtagtgctgcgcgacggatgggaagagaacaagatcaacgtcatgagaaagctgctccgccagaagttcggcaccgagccgctgaagtcgaagctgctgaagaccggcaacgcaaccctcgtcgaaggcaattggtggggcgacaagtattggggcgtgtgcgacgggaagggcgagaaccatctcggcaaactgctcatggaaatccgcgaagaacttcgcatcgaaaaggaacagcacaatggctaagcgtattctgatctgcggcctgcccggctcgggcaagtcgaccttcgcgcgggaactcgccgcgcgcctcaacgccgctcacgtcaacggcgatgccgtgcgcgaggcggcgaacaattgggacttcacgctggaaggccgcatggagcaggcgcaccgcatgcgcgctgttgccgacacgcacgaaggtctggttgtgtctgacttcgttgcgccgacgccggagattcgcgcggtgttcggagcggacttgaccgtcttcatgaacacccttgccgagagccgctacccggacaccaacgagatgttcgtgccgccggagaacgcggactacgtgaccgaacgttgggcggacacgaccgagatgggtcacatcgccgaggcgatccgcttcatgatcccccagggtctcatgatcggtcgctaccagccgtggcacgcaggccacgcggcgctgttcgagcaggtgctcgcgaaggaaggctacgtcggcatcggcgtgcgcttcatgccgaacggcccgagcaacccgctggacggcgtagcggtcaccacgcgtatcgaagccgcgcttcagcaccgccggggctgcttccacgtgttcccgatgccgaacgtcaacggcgtgtactacgggcgcgatgtcggctacaaggtcgagcagattcgcctcactgaagaaatcgagtcgatcagcgcgaccgcgatccgcaagcgaggcggcgtatgaagtacgtcatcctgaaggccacgttcgccgacatggacgtgagcaaggcgttccccttcatcttctccgagcacctgacccactcggaaatcgccaaggcgatgaagcggcacgtcaccatcgagcttcgaccggccaacgtcgaggtcgaagtccacagcgccgggttctgcaacgtcactaaggacggcttcgtgtgcgtgcggggcagcgaaacgctgaacatcaagaaggaagagacgcgctgtgccgatgacgagcgcacgatcaccttcaacgattccatgagcatcatgctgtaacaaccggagccgagtgccatgcgcgagatgtatcaggaaatcacgttcaagaagaagagcctcgaaatgatcgaccgcatcaacggcatcattgaggtctatcaggacgaaggctacacgctgacagtgcgccagctttactaccagctcgttgcccgcgacatcattccgaacaacgagaagtcctataagtacatcacccgcctcgtcaacgatggccgcatcgccggtctggttgattgggacgccatcgaagaccgcacgcgttcgttcgaggcgcgcgggcgttggaataacccgaaggacatcctgacggccagcgccaagcagtaccacaccgacccgtgggccgcgcaggaccgccgcattttccttgtagtcgagaaggaagcactggtcggcgtgttccaaaacgtgtgctggaattacgatgtgccgctgctcgcggcgcgcggctacccgagcgcatcggttgtgcgtgatttcgcgcggcgggaaatcgaacacaacgccgacaaggacgtgctgatcctgcacttcggcgaccacgacccgagcggcatcgacatgacgcgcgacctgatcgaacgcttccagttgttcggcctgggcggcgagttcgagttgaagcgcatggcgttgaactacgaccagatcgaagagttgaagccgccgccgaacccggcaaaaaccacggactcgcgtttcgtgaattaccgcaagcgatttggcgaatcgagctgggagctggacgctctgccgcccaccgtgctgagcaacatggcccgcgacgaaatcctgagccacatcgacgcggcggcttggaagacgtgggacgatggactgaaggagacgcgcgagaaaatgctgaagcacgtcgagaagttcaaggggtaagccatgatctacatcatcgccggagacgacagacaggccgaacagtgcgccgacatcaaaggcgcatcgcgcggcgagtggaagcgggtagcgagcctcaacgacatccggggccgccgctgggacggcatcacggtgtatgcgttcggtacgttccgcacgcggcacatgttcgagtggcgcgagatggtggaggcgctgcaacacctgggcggcaagttggaacaggtgatcgacggacgcttgacacgctgacccacgcggccttatggtcgagtcgtcgaagcgatattgcccttccagccggaccagcgcatagcgaaaaccggaatcagcagaaccacgcagtcgacacccggccaccgacgagagtcgcgccacccccggaaggccccgtctcagcaacggggcctttcttttgcggtcaagaccaaccggggcaagaccaacttggccttgaccgcaaaagaaaaccccgggtgtttagtccggggtttccagttgcaggctgagcgccgattctcttcctgcgttccctaccgaggtgccgatgcaacgcgaagtgcgaccagcggccctaaagctatccccgaccgccggggctgtcaactaccggcggatcgcccccgccttctcgtacccgtccaggcaacgctcctgcacggccgccagggcgcgttcccgcttcaccgctaccagcgtactggcaacccactcggcggcccgtgcggacagccgggcgaggccgttgggccgttcgggggtgggcggcacccactccacccactcgtcagccgccggtagggggtccaggggcgtcgaggcggcctgtcggcagtccacggtaggcggtgccgggcgaacggcctgcgtgcagccgcacagggccaccagggcggccgccagcaccagggcgcgggcggtcatggcacacccccgttcgcgtccttccagcgggccagcagctcggcctgcaccgccgggtcgaccgggtggacgcagctaccggggctgaccggcttggtgacgatccggtcgcggtagacggttcggatggtctcgacggtctcgaccttcgtctgtccggcctgctgctcgaccgccgcggcttccttgtccgcctgctgggccacgtcgcggcccttcgcctcggtcttgatgtactgcgtgttgccctcggccttgcatgcgtcacgccccttctgttcgtagtgcgaggcgaagccccaccagcagagcagaatcaccacggccaggatcaacccctggcccagcctcgtgttcaacaaccagctcatagaaccccctccggccacgcgggcaacgggatgttgttggcgacgagcaacgcacgcagctcgtggatgtagaccagtcgtttcgctgaaacgtcgtcggccgcctgcgccatcctttgcgcgtgggacgctgcttccgatgcgcgtgcggcagcggcttttgcagtgtcagcttcgatgctcgccatgttggccgcgcgcttggcttcgccgatttcgttgtacccggcggcggttttgttgaaaagctcaccgagttgttcttccagctcccggttccgcttctgcaaccgctcgatcaaatcagtcttggccgcgttctcggtgtcgtcgagaatctggcccgagcgctgcctcttgatgacccaaccgacgccgccggtcaccagcgttcctagcagtgccgccacccacttccaggcgttcgtttcatccaccgtcaattcccctgtcatgttgtcgaccgcagcttccagctcaacgtccatcacgctgtttccagatcgctacgagtcgcctcagtacggagcacgcagaaaacagccatgaccagggccaggatgtgcgtgccaaccaagccccgccagccctcgaaggcggcataggacaggcagatgataaaccaagtgaacagcgcgaacacgttggaggcccaagccagccacgtcaccggccgcgtggagagcacgcgccacagcatgagcgacccgctgagccatagcattgccgaccatgcgtagaccggcagcgtggcgaacagcgcccaccgggtcggggcgggcatgggccggaccagcaaactcgcgccgaagatgaggctttgcagggcgagaatgaaacgcaccttcagcgtcgtgccttgggtgatggcgtgccacaagtcggcaccgattcgcggtttgatttccatctcagtttcctccgaattttctatgggctgctgcaagtttcacgtcgtattggttcttgcggtactgcgagccgttgtactttctcgcgacggtggcccaatcgccgcgcttcaaagcattccacaactcggtgtcactctggatgaacgccaccatgaggtcgagctgcgcgccctcgctgcggaacatgcggttgatgaaatcctgcaacgatgccgctccgactttcttccagttgttgcccaggatttgcgggatgccccagctcgttgcgcgcagtgcggcgtcgcggtcgagcgccacggcctgttgcagtttgccgtgctggctggcgtagctgctgtagggaaccgcgccccacaccggattgctcaggtgcgggtggctcttgtcgaagcggccgcccgtgtactccgagaacttgtgcggctcgaacaggatcgtgacctgcccgtcgtcctgaaacccgccgcgtggcgcttcgacatcgagaatggcgcgcaccttcgcctgggatacaacaagggccttggctgcgcgtgcgatgtcagcgtcggtgagcttcttcgagtcggtcatggtgcttctcctgattaattaagggccgggttcggacgtgaggcgatcccacagtaccgagttctgcatgatgccgccgtccgagtcgaaggcgattccgtagtacgcctggacgccgggcatgaggttgttgaactgcacgtagccgttcgcatccgagagctggatgtcgatcagcgtatgcaggcggcggtagaacaaagcgacgcgcacgttctgcaacggcgtgtcttcttgcgtatccgggtctcgctgcatcacgcggccgcgcagcttgtacgtcggcagcacgttggtcgaccccggagcgccccaccatggcgggacacctcgcgtcgacttggtggtctgcaccttccgcaaactggccggaggcgcgcgatagacctcgatcttcttgaccgaatcaaccttggttactttgtcccagccgatgcggctgcggcgaatgaacgcggcgaggcgtgcgggtgcaggcggcgggtcgatgacgttgatgtagacgttgcgaatgccgcccctgaaaatatacgagaagcccaagtacaaacgaccgccgattgcaaacgtgctgaccgcgtagttgtagttgcgggcgtgaggcaccgacgcttccactgcgccgtccaccaaaacgctcagcacaccgtcccttcgacggaacagcacggtgtgccagttgccatcgttaaccgcgctcgtcgtaccgattaccggcgattcgttggggccttccgccgtccagatcaaacgcccctcggtgctgaaatacacctgccacgtgcttccgctgccggtcaggtagtctagaacggtggagagcgtactgctcgtagtctggatgtcgaaagcgatgtcgaaatctttcgtgccgagcaggaaatcgccgccgctgttcgtgtagatcagaccgtcgcctataaaacgcgccgctccgtcgatgatgatcggagcgacgctgtagccgctccaaaatcgacctgtagcgtctgcgtacgaagtcgatccttccggcgagcttaggggtaggttggcgagcagcatttcagtttaccgatcccaggtgtcggagatttcaaacaacgcggagttctggtagtgcacccgatggaggaactgtttccctgccagttcgccctggccttcgaccaacgcgccatcgggcaggattccgaagtagtggcagtgaacccaaatgccgggcatgatcccgcgaatactgtagggtccgacattcgggttgtgcgcccacaccggagagaggtacagcccgccgtcagggccgtgaggatagctgaggttaccgttgccccaactgctgttgcccttggtcatatcgttgtgccagccgagcgtgatcgggccgcccaggttggtgaagtcacgcgcaaccgaaaggcggtagcggttcatcgccgaagaaatgctgtaaccctggaacggatactgctccgaagagttggggctgtcgggcgagtcgttctgcaacaggatggtgtgcgtggtgtcgcccggcttgaacgggatgatgtcgccgaacgcgtagcactcgcggtaatactgcgtgccgctctccgggtaagtggtcagcaacaaccagaagaacatctcgtctgcgataatcgtccacgggcgggggttcgccaccgagccgctactgtagtgggtgaaccaattgccgccctgcgggttctgcgcgagagtcgggaagggcgacggcgagccggtgttgacatcggtcatgacctcgtagccgacgaccttcgccttacggtagctggtggcggtgctggtgtcgtccacgcgcaggtacatgccattggagccagggccttgcttgaatgcggccacgttggtgccagcgaacggcttcgtccagcccgcgcccgccttgctgccgtagccggtgacgaggcacttttcgagcacgttgatgaggtcgccgggcgtattgccgcgaaggaccggagcgtctgcgtcagaagaggaataaactcgaacagtcatttcagaacctcacatagtcaagagaagcatgtaggaagacttgcgcaactcgttgccacctccgtcatcgtcagcaccgaaaatccactcgatgttgggcgacagcggcgggttgtactcgttgcccttgaacacccaaacgatgttgggcgatagcggcggggtgtattcgtcggccatcgtcagattccatccaccacggcctgcacatcgtagaagccgtcgtcatcgtcgtacacgaaaccgatgcggtcagactttcccggcgtggaagtggcgttgtaggtcgagatgaggttgttgaatcgaacattgttgctgaaggtaaccgcacggccgccaacagcgtcttgcttcagcaacagaacgcaaccctggccgtccagagcaccttccatgttgatctgcgtgttggccgtgagcgtcactcggatttcgtcgtacgagttccagtcgcagatgaccgagccgctggtggtgtcagtgattctctggatgcgacgctgcgatgggatgccgggcggcccctggataccggggtcacccttcgcgcctttcaacgacgccagccactcagcttgcgtaccggcgaatccgttcgccaccgccacctgatacgcgctcaggccgttcgcgccggttgcgcctgcgttgccttgcgggccgcgcagggattcgagcgacacgaggttgatccagttctcgtcaccgacgtagcgccagcggatgtagccgccgcccgtaccgatttcgatcagccgcccctcgaagaaaccgatgctgttccagggcgtcacgccgtcgccgatcttgaacttggtctcgtccgaagtcgcaccgagctgcacgccgatttccccggccgcgaggaccgggttcttcgattgccagttcgccgctacgtcgcggcgctgccacatgcgttgggcaacaactacctgggccattacgcgccgcctccgtcaagaacgtactccggctcgtcgaccgcgatggtgttcgtgatcgtgccgctggccggagtgtagctgaagtaggccacctgcttcgaccacgaggccaggccctcccgcatcgactcgatttcgatgcgcatgtctcctgctactgcgaggcggatggtcgcggcggtagcagcgtcggagaccgcaagcgcttctgccagtagggcgttcgagccggtgtagacccggatgttgtaggtcgtcccttcctccggcgtacgtgacggatcggcctgggaggcgatagtcccgtccaggcggttgcggtgcgcccaggtcaagatcatgtccccggtgaaggccgatccagcaccgaccggcgcggcgttgacccggattcggcccggcggcagcggccgcagagagcgcgagttggtcgtgaccgtgacggctgctgcgaggttgatgtcgagcgacgacgacacgttcttcggagctagcttcgtgttgaccgtgacgttgcccgagtagccgtcgacgttggtcgtgcccgcaccttcggacaggaagaacacgcgtgcgccggtagcgtgatcctgcgggatggtgtcgagcacagcgcggtacaccccggtgatcgtgaacgtgccgttgccgttgtcgacgatgttcttccatgccatgagttcgttgccgaccagcagcaggttctcgcctgcctctcgcgaaccatcggtgcctgggtcaagaccggtcagcccgatggccgacgacacggtgaagcctgcggtgtcgacttccgggccagtgcgcgacagaccggccaagagaacagcagacggcgtgtagccctcgaccacgttggtgatctggtaattcgacgcgccgctggggtcgctccacacgtcgtagccgatgacgccgttgctcgcgggcacgcccatcgtgatgagaaagcgtcggctcatatcgtcagcgccgaatgccggggcttcgatcacgcgctgcgcagcgaacggtgcgagagcagtaaccggcggaacccaatcacccggacccggcggcacgtacgctacagcgttgacctcgaagatgtcctccatcgcggtgatcttgatcgccgggtcgtccagggtgccgtagctgatttcgatcacgcgcatgagcacgttcgccagtccgcgatccggcttgcgcagccagaagccggagccgggacgcagcttgtagccgatgcggttgagcgacatcttcgccgagaccagcggcgacgctttcattttcgacacgcgagcagcggtgttcatcgccgcagtgtcattgctgaagccgaggtagctgaaggtctccgcgtcgatcatgccgccgcgcacgtcgatgttggcgaggtcttggtactgcaccggcttggtctcgaacgaggcgcggtcggtgtactcaacgatgatcgtattcttcgtcatctcccaggacgtgcgcgagaagtcgaagctgtcttcgaggatattgctgtcgtcaataaccagcaggtcgtccttctcggcctgcgagaactcacgggccagcgtcatcgtgtacaggccggtgaccggatcggcgtacaccacggcgtcagcgtggcgcagcacttcggccaggaggtctttgccgagcatggccgactgcaccagcatcgaaatgcccagcgactcttcagccagcaggttgccgcaagcgcggaacgagtcaacgtcgatcttgtcttcagggattttcatgccccacatgttgttggtcatcaactcatacgacgcgcacgcgatattcgcgtcgccgttgacgttgtggcggccgccggtcaggccgagctggttcgggcagcggcgagcaatgatcgagatgggcggcggcgtgtcgctgttgccgaggtagcacttctccatgaccatatgcaccaacgggcggaacgcggacatgtccggttcgttccactggccggagaggtagttgttcgtgccctgcgtgaacgtgccttggtacagaacgcacttgccaactacgccgctcggcgggtcgccgttgtcgagaatggacggcgagcagatgtagaactcgcacttgtcgccgacgaactccttgctcgcgacctgaccggccagccacgtgtccttgtacttgaacaccgagcgcacaaggtcagccaccttgtcgtctacgcgcagttcgatgaactcgtctgccgggccgtagccgaacacgagctgcacgcccaggtagtagttgtacccggtgacgatcttcttcgacgagaaccagccggtcttgaccttcttcttcagcgtcacgacttcgaggtcgccgaaccacaccacattcggccccatcatcttgcaggtgccccaccacaccggtacgacgcgcgaggcgtccacggtggggaacttgaagtcgcccacggccgatgggttcgggtcgttgaacttctgcttcggccgcagcagctcgccgacgattgcgacgacgattgcgacgataattgcgatccaggccattaggtgatcccctgctggaagacgttgtaggtcgggaagtgatcgaacccgacgtagttgatcttgttattgaacttgcccgagcagacttccttcgtgcgtgcgcagcctgcgtacacgtcgagaatctgcccgccctgcaccgtttggaacggatacacgaccttgatcgtggcggtggctgcgtcatgcgccgtgatgaaacgctgctcgccggtctcgcggtcgacgatgaagccgttggtgtagtagccggtcggcttggacgcgaactcaggcgagccgagcgtgtagccgtccacggtggtgatgagcgcatcacgccgccacagcgacttgtcgacgccgcaaccgatctggtacagcgcccacacgcaaccgaccttgaacaccacccacggcaccgtctgcgaaaggttgtcgatgatctgcgagcattgcagcgtcgcgtcagctcccttctggctgaagctcgtcacgaagccggtgaacgcctgcacgatttccgcgccggggtcattgcgctggtacgcgtagatcgtcagcttgatagggcgaggcggcagatacggcacgtgcgcggccgccacggggttgtcgaacggcacgacgacttccaggctctcgacgttggcatcgcctgcggtctgcttcagctcgccgcgtttaatcgcttcgggcctgtaagtaatcgggccaatcgagcgctcccgcgcatcggtggtgtacgcccagcggtaacggccgtcgtcgctctcaaacaggtaaagctccacgcgagagccttgttctttgctgctttcgtattgggccagagacatatcagtcctcggtcatcttggcgaccagcatcgactcgacggtggccttggaatcggtcaggtagcgcaccgtggtggaaggagactggaagcggtacagcgtcaaaaaactgatccgacgaatatcctgcggccgcacctcttcgccgagcgcactgtcgagctgcaaccgggtcaggttgtcgaactcgctaaccagcgtaatgcgacgacagaaataccgaccattcttcaacaggatgaagatgtcgcggcgagcaggatgcgcaccgaccagcttcgcgtattcgttcgactccaccacgagcgagttctcggtgtcgaggatcgtcgccgccatcgtgaaatcttcggtgccgctcggcatgtagaccgaacgagcaacaccctggcgacggccgaggaaacgacggaactcgaaaatgtcagcgcggtcgaacagcgtccagttatggcggcggctgattttcgagaagcccgaggtggtgaaggcaacgaacttgcctgtgccggtgtctacgcgcttcgtgtccgcgctgaaggagaaaggcatcgccgacagccagttggtctccttgatgtacagctcgtgccctcggtaggtcatcgggtccgggttcatcgccgcgttgcccggcgttacgctcggctcgaagtcgaacgacatcgccatgcggccaacgcgggaagtctcgcgctgctcggacatctcttcgctcatgaggccaacgaaacacggatacacgcgcgagtcggcaggccagtcgtactccaacccggtcgtgaccgaaacgccgtcagcagtgacctgctgcacttcgcggatttcgttcacctcgtcgtcgagatacagcgccaccagcgaaccgggttcgagcgacaggccgaaggtgttgaaggggataacgagcgagcccgcttcgacggctgcgtcggtacgcgactcttcgccccaatgcgggacgccgaagaagcgggcctgccatgcgaacagcagattctcggcgcgctgggcctgcttagaagtccgcagattgatgttgaactccaacgtgcgtcgcggcacttcacccgactcgctaccggtctgctcgctaccgtcgtccgacgacagcacccacgagcgatgcgtgatcgtctcgtcgaccggagacccccaattcggagagaacgggaagagaacgatgcggcggccggtgatcggcacggtgtagttgacgccttccacggtgaagcgcgcatagctgctgatcgtcggcgggcctgccagttcgatctgaacggtgaaatccagctcacgcagcggcggcatctcgaacggaatgctgacgcccgccgggggagacatcgaaatgcctgcctgcgggccgagcacggccgactccaacgtctgcggcgtgacgtaggcattccaaaggatgatgtgccggacctgcgtggacagcagattgcccgcatccagggcggccgggacgatgaagatgcggttgtagtagtcgtcgaagaagctcgtcatcttgcgctgcgccgacacaccccggtggttgctcgaatgcacgtgccagctaccgtagcggccctgcaagaagcgaccgccgtcgtagctgtcgaacatcgacacgacttcagtcagtttgttgaggtcatcactgagcatcgggttgtcgatgccccgctcaaacgcgctccccatttgtccgatacgtgctgccatgtcacggccccgtgtagcgaatggcgtaggcaaacgtgccgctgtgatccgcgccggtcgaccacggcacgccgttgcgcactgctgcgttcttacggtggaacgggtacaccttccagcggtcggtgccgtaggtcacgatttcgccggacaggtggttgtcgttgcgacacaggcgcgcgttttgcaggtctgcggcgatagtctgccccttcgagagacgacgctgcaccgcgagcaacggcaggagcacggtgctctggttgaactgcgacggcagcgattgcagcagagcggcaactggatcgccgctgcccatcaaatcaccttcgctggtccctacgcgcttccacccggttgagtccaggccagtgtggatgtaggagcagcccaggggcgcgttgtatacctcgtggaacaagccacaccccatgccgctccacccgaagccgacgtagctatccgacgcgttggtgtacacgagatgggttgccgcctgcaccacgtcactgcggaacgaaccggtgagccacatgccggtgccgccgacctgatcgacgcgagacttgccgaacgacaactgctggtacttgtcgccgttgtaattgatgacgaggtagacctcatcggtttcctcgaacacgtgcaggtcataggtcgccgggaagttcatcggcgagccgctgaagttcatgattttcacgccgtacggagccgcgcccggcagagggaacgggtcgacggcgctgccggtgcctgcgaacgctgcgatctggtagatgtcggtcgccacgaggcggacgtacatgccgttcttttccagcgtgccgtcgccgttgagcgcccagccgtggttctgaagcgccgcttccatcgacgccttcagcgtcacgaacgaagaaaaattgccggtgtagaacattaggtcatctccaagccgatgaagctgcgccagtcggttcgacccacgtcttgcagcatcacgaatgcgcggccgcccgccgcaaggactgcatcgacgtgctcagccacggtcatgccggtgctgtccaccgcagtgccgccgacctgcaccacgttctccacgttgttgttgaagccggaaatctggtacacgccgtccagctcgccgaagacatttcccgcgtaggtgtcgccgctggccgtggtggtgtacaggatgatcggctgcggctggtagttcgttcctgccgggaccagggagcggtggcttacgtccgtgtccaagtagctgtagttcgccaacgcgttgtagccgttccacgagttcgagccagccgcgccgttatagaacgggaaatgcgagaggcgacgccacgtgcctacctgatcgcgcagccacagcagcgaaggacgctccggggaagacgcgccgctctcacgaccgtgatacgggaacgcgtagtcgaggtccgagaatcgcttcgccgctgcgccgtcgaacatgcccgcgcacaccagcggcgaggggaactcgccggggcgggaatacgggaacatcttgcctgcatagaagtgcgtgtagaccggcgtgccgactttgaagcaaccggcgatgcgctgggcgttggcagtgatgaagtaggtgacggcgttgttatggcacggcacgccagaaagccgcgcgcccggctgagcgtcgaacgtgttagccgatacgaagccggtgaacacgcccacgaggatattgtagtagtcgccgctcgtgctgaagtaggtacggaagccgatgtagatgtcctccgttcccgacaagcccttcgagttcaaaatcagctcgcggttcgtgcctgtgttgacgtagcgcagcgtcgtccatccgttcgcttcagccagggtcttgatcgcagcgagtaccttgtagtacgcctcgtcgccgctgccgcccgtaacagttccgattgcgtgtcccatgttggttcctttaattgcccaggagtttcttgaaggaggctcggtcagccttgatgacgttgaagatcgcctgacgaccagcgcgggtgttagcaccggccgcaaccacgctctcgctgtcgatggtgttgatgatagacaggtctaccggggccgggccgctgccgccagccatgccgccgttgaagcggtggcgcggatcgttttcggtcaagacctcttcgttcttcttcagcaccgccggtacttcgtcggccgcgaagcccgccacgccgcccgtgtggtagcgcaccgcgctctcgtagacgtagctcggcaccgcacgcttcttcgacgccgcgccgaccacaccgccgtcatgcttcacgtagctcatcgccgcgttgatgatcgcgccccagccgccgctcgcgctctccgaagcctgcttcagcgcgttgaagatggcctgctggataatcatctgcgcgagctgcacgagaatgtcggcgatggtgttgagcacgatgtcgccgaagctcttccatgcgtcgcccgcactctggatgcccttcaggtagtcggacatcaccgccgcgctctccatgaaggcgttcgtgaagccgttggtgaacacgtcgacgatcttccgcttagtcgccgacatctcgaccgacatcgccttgatctgcgcattgaggttttcgaggttcgcgcgagcagcctgggcctgtgggccatcgcccagcgtagccatgaactcgaccgccttcagtcgcagagcttcgagctgcggcagcagacgagcgttgacctcttccatctgcgcggacgcttcgcttgccgtcagcagaccggcttcctgcaaggtgttgatcgtgtcgatggacgtgctgcgctgctgcaacagggtgttgatgcgagcctcgtagaactcctgctcggccaactgcttctgctgcttttcgaggtccggcagtgcgtccaggccgcgctgcgcttccttcttcgcatcgggcacgtttagcttttccgcctcgcggatcatgcgctccaactctgccttgcgatcagcgatcttgttgtcgatcaccttcagccggtcttccagcgtatccgggcgcgcctgggcgatgtcgctgtcgatgtcgcgcagcttctcggccacgtcttcttccaggcgcacacggcgctcggccagggcggcgaggcgcttctcttcggcctccttcttcttgcgcgccgcttcggccgccttcgctgccttggtgtccgtgcccgcacgctttgccgctgcgtccgcctcggcctggatgcgcttgaactcggccgacagcgcatcgttctcggtcgcggccgccttcgacttcgcgatgccgaggtcacggctggccgatgcgaccagctcgcgcagcggggccgcacggcgttcgaggttggcgagctgcgcctccatcgccttgccctcggcctcgacctgccggatagcctcgaactgcttcgacggcagattggcgtcgccttcccgagtgctctgcgcagtgcgaatcgcgacctgattcttgcggatggtcgtgttctgcgcgatctgatcggcgaggttcttcttctgctcatcgtagatcgtgagcaagcgctgcgctgcctgcacgcgcttttccaactgctcggtgttgtcgcgcgacagaactgcgaggtttcgctcggacgccgcaaaaccacggttgagttccgtgacggtcttctgcacatcgagcttgtcgttgttcgacttcagctcgcccttcatctggaaatagatcgggatgatgacgcccgccgaagcgattgccagcagcgccgcgatggggccgccgatcagcgccagcagcgaagcgcctgcgcgaccggcagacgcggccgtgcccgcaccgagcgccgtgttgagcgcgaccgtggctgcacgggccttcaggatttccgtagcgagctgagtgaagacgatggcgatgcgcgctgcctggatcgccagcatgatcgcgatcagctccttgaagttccgcacgaggaaggcgacggtgttcgctacggtctcgatcaggccgtcgtactcggcgaatacgtcgatcagctccttgcccgcttcagcggccgcgacgaagaccttcgtcagattcgcagcgaacttcttaccgtcgtcgctcttcaggaacttcgtcagatcgacgaacaggctgcgcagcgcagtaccgaggccgccgtcgatgatttcacgcttcagatcgccccacgcgttcgacatgcggttaatgtcgccgagcaagctgttcgatgcggccttggcctgcggaccataaataccgcgcgcagtttgcgccgccagcagcacgaactccgccttaacctcgccgcccttttcgagcatcttattcagctcttgcgtcgacacgccgatagccttcgcgaacaaattgaacgcgccggtcatgcggtcgccgagctggccgcgaagctcttctgcctggatgtagcccttcgagaaaatctgctccaaggcgcggaacgcgccctcagtctcttcgccactcaggcgcaggaccgtcgccgcttccgtgaacgactcgaagatataacgcgttgcttccgccgacataccggcatcgcgcgcagcaaccgagaaccggctgtacgaatccgccaacgggccgaaggcgaggcccagctcgtcagccttcttgcgcagatagtcgtattccttcgccgccgcgttggcgtcgcccttgtttgcgatcatgagacgcgacattgcgcgctcgcgatccacggcggcgtcgacgctttggttcaccagattgatcgcgccgaacacgcccacgtaggcagacaccagcgagagcacctgaccacgggtacgctgatacagcgacagcgcggtgcgctgcccggtgttgagcgcgttgagctgcttgctggtcttcgcggtcgactgctccaactgcgtcatcgtctgcgcgacctgcttctggccgttcgcaacgcgagtggcgttctgagcgaggcgctgctcgatgccgttgaggttttccagggtgatgcctgcggccgccgcacgctgctgcacgcggttgaacgcttcggtctgtcgacccaggtctgcctgggcctgccgcagtgcggcctgtgcgcgttgcagcgacgccgccagctcgtcgttcgggcgatccgatcgctccacggcttcggcgtagcgcagcacttcctggcgcgcttcctcgaaccgctgctggctggcggtcaaggccgtgttctgccgcgcgaggtcatcggcgagaccgccttggcccttcagcgcggcggccgcttcccgcaggcggcggctctggtcggccagcttctcgatgccgtcagcggccttcagggcgtccggcgtcagggcctcgaactccttgtcgagctggtcgacggccttttcgagctggtcgagcgtagcgaccgcctgcttggccggttccagcaccgcctgtacgcccgctgctgccccgcccagggtcgacccgctacccacggcaggggcggcggtagcgcgggccgcctgcgcagcctgcgtgccggtggcgcggaagttcgccccggcggccgccgccttctccttctcgcgggccagggtgcggtagacgttggtggtcagctcgacgaagcgctgctccttccgggcctgctcttcgcggtccttcgcggcctgggcaacagcagcggccgaatcgcgggcggcctgcgcctgctgccgttcttcctgctgcgcgagttcctgctgctgccgcacttcgcggacagcggtgtcgtagcgctccatgttgtcggtcgactgccggtacagcgccagcgagttgttgaccgcactgttgagttcctgctgcgactggctgaagcgggtcgtgtcgacgcccatctccttcagcttcgcgcccgacgtttccaggcggcgctcgttattccgcagcgacgcgtccaggcgagtgacttcactgccagcggccttcaactgctgggtgaactccttcgtcggcttctcggtgttgtaatactgctgcgcgagcgtgttgaggttttcgcgagcacgcgcgagttcttcgcggaggctgcgcacctgctgctcttgctgagcgtagccttccagcttgcgcgagcggtcgttgagcgacttcatgatagcgagcaacttctgctgctcgcccttcagactctcgaacgaccgctcggcgagacggttcgcatcggctacttcgttttggttttcggcgactttgcccagctcgtcattgagctgagaaatggttttcgtactgaggttcttcgcacgtacgatcagttcaacttcgttctgagcggccatcgcctatagctccgagatttgttccttgaatgcctgcgcgcccttcttgctgagcgcggagccgattgcgctttgaatcaaaaccgcttcagttctaatgcggttgttgacacgctcgcgcgcgagttccgtttctacgatcaacacacccagcggatactcgcctgcgagagcgtgtccttcagcggtcaggaaggagactgctgctcggattccgagccaccaccctgcgaatcgctcgattcgagatttttgtttcgcaggtgcggcaccacgctttttgctccgcgaagtgccgcttggacgtttcccaggaactcgcggaatccggcctcgtccttgaaggtaagttcggcgatggcgcgcatgcacttgatctgcgtcggcgcgtcgagctgcatggcgaccatccacgcttccggctcgtgcgcggcgtacgcgataacgcgtgcgatgaagtccggcatctgcaccatgagcttctggccgatctgcatcatgtcgacttcagcgaggtcggtggctttcttgacaccggcaccttcaacgatgtcgaagatttcttccatgttgtctttctgcgcgatgatgattccggccacgtcgttggcgttgaggccgaacagcacgatgctctgctgctcgtcatccgcgcccaggtacgggacggtgatggtgcgaaggcgaagggacgaaagggacattggcttcctcggttgctggcaagaaaacaggccgccccctttcggagagcggcctgtcgaagttggtcttggccttcttggtcttgactaagttggccttgaccgcgtttgacgcgccccggttacgccacctggggacggccgtcgatgtagacggtagcgtagccgtccagcttcaggatgtcgaacgcgaagctgagctgctgccattcgtcgcccttcagggccagatcgccgtccgcgcggagctgcacgtagggccacaggtagtcgcggcgcgggccggtcgggttgtaggagacgaagcgcagcgcgccttccacggtggtgccgtcgccgaccacgacctgcgagcgggtcgaggcggccgcgctgtagttgatggtgaacgcctcggtgccgtcgatagcgccgcccgggaccacgtagagctggcccagctcggagtcgacggtgtagtcctcgttgagcgtgtacgggacgggggtgcccgcgccatcggtgacgctggtgatggtcacgttgcgcacgccggtcgggttcgccagcgactcgccgatctggatgtaggtgcccggcttgacgcggttggccggaaccacctggacctgcgcggtgagggccgcctgcgccacgacgctcacgtcgcccaggaaccacagggccacgttgtcatcgctgatttcgtcggcgatgaaggtgccgctgtcggtcttttccagaacgatgctcttgtccttcgtgcgaatgccccggtcactgttgaagtgatcgaggttttcgctctcggtggtgaggttcagttccggggtgttgcccaggtaacgctcgccggtcttgttgcgggtgcccggtacgaacttgtcgaaacgcagttcgccacggccaagggtgtaattctcgctgcccattgtggtctccttcgggtggtgttgcaggggttaatcacgaatccagtacgggtctcccaccttctcgacgagttccattcggaccctcatccagaagtacgctttgtcggattgctcgtcgggaggccgaacaaccccgggttcgatggacagcgtgtttgcgagaccaccgaagaacccgtcttggttgcgcggggtaatcaacttccccagcgccttttttacgtcgcccatgagcagatgtgccgcatccgtctcatcgtcgccctcggccagtcctgagttgtcagcccagccgttgagcaggtaaatctgatcgtacttgtgcttctgcccgacgaacccgccgatagtttccggcaagcggtcggggttgaagttttccagcaccgccacgcccggcagcttcatctccttgccgaagttgcgcttgtcacgacgaaccatcgcgaggtcgaagttgtagccgttcgccagggtgatttcgctcttcaggtaatcgcagagcgtcttgaccagcaacagtcgcttcgtatcagccacggttcaatctcccgaagttgcggaggaagctcgattcgagtgcgtcacccaccgggccttgcacatcgaaccgaacatcacgaaatacttgatcgacggacggaccatacaacaggtagaggcttccgctcacgttgaccgcctgcttcttgttcaagccgccgggcagctctccctgcttgttgagccgcaccgcaataccttcgttcgagttctcggcgtcgtacacgccgttgccgcgccgcagcttgatcggaaatgcgccggggatgcgcttcgatccgccggtcgcggaaaccttgactcgaacgtagccgcctttgccgagcttcgcgccctgctcgaactgagccagagaggtcggccggtgacgaccggagatgacgcctacgaggtcgcctacgcgggccttcttcgctacacgcagtctcgcgcccggatcggtcgcgttgccgatgtagctcgccttgaacgcaacctgctcgcgaatgcgacggctgctctcggcctgaccgaacgtgatcgcttcgttgatcgcaacagccgatgcgcggtcgaccgtttccggtatgccgctcaccatcttgcgcacgtcgtcgagtccgttgatggtcaggccgatggtcatggagcggtctccgttactgcccacttgacgtagcgactgtcctcggaaggatgctccacgtcgagtttgaaagtcctgttgagctgcgggaaattaatccggttgccctcttctgcgacgatgccgtttgccagcagctcgcgagtgtcgatcacaacgtagtccacatcgtcgacggtcgtcgcgaagccttcgcggtcgaggtcgccgtacgtgcgcaccttgtagtgcaaacgagcggacgtgtccgtagacacgccgcccgccgaacggaacagggctgggataccgaacgtcttgtgcgtcacatcacgcgcgcgttgtttgatttcaagccagcccatgttccgtctcctagcgcccaggcgcgattactgctgcttcttgccgtcgttcttgtcggtcgtctcgaccttcggcggggcggagccagagctggccggagcctcgtcttcttccttcgccgcgtccttcgccgacttggcgtagccgttgtcgacgagctgcttctgcaacttggcgtcttcggtggtgaactcctggcccgcctggatttcctgcatcgcggtgcccaggccatccagggcatcgaagtcgcccttcagcgccacgcgagcgaccagcttcttgccagcggccgcagccttggtggtcttcttgtcgtcagccatttctacatctcctgttgcggggttgattgggtggtgtaaacagcgcggcccggcgaaccgggcgttgctggtgaaacggccttacgcgacgacgcgtgcgcgcagggtgcagttcggacggctcgggatcatgagcggcgcggactgcgacagcaggtagatcacggacgggtccgggttcttccacatcttcgggaagatgtcgagcgcctgcaaaccggcgtcggcatccatgatcgcgccgaaggcacgcacgccgtcgaagccaccttcagcttccagcagcacgtcgcgcgggtccatcatcggctgcatggtgccggtctcgtcttcgtacacatcgctgtacacgtagatgttgaacgcgccgatctggcccttgtactccacgctctcgcccaggcccgggccggtctcggcttccgacttcgagccgcgacgggtttccagcagctccttgatggccgggtgcttgcggaacgccttccaggcggtgctgcccatcgtgacgcgagtgaccacgaagccttcagcttcacggatacgcgcggcccaatcttccaggtcgtcgtccgggttgctgttgtcgtagtcgctccacgcggcggtgcccgacaggatgacggtgtggttggcggcacgaccgaagtcgatggtcacgctcgggtagtcttcgcccgacacggtgacctgaccgtacagcgcggcctgcgcgcccatccactcgaagcggcggtaaatctggttgcgctgatcgagctggtacgcggccacagtggcctgccagcgctggcccggggtcatgtcgccggtcagaccttcaccggccaagcgacgcagcatgcggcccggggtgaccgcatccttcggcttgacgtaggccggacggaaggtcttggtgtagaagccggaacgcttcaggacgcgaccctgcaagttcggagccacgaacggagccatgcgacggccgagacgcagctcgtcgaacatgatttcttcggtcgtgaagttgatctgctccttgtacagacggtcgaggaaatactgcacgggcggccggctgtcgacgatcaccttgcgcagttccgcagtgctatacaaatccatcgtgcttctcctgtttcagttgagttatgtgcgaaacgtattgcgggtgaatcgccggttagaccgggccggagttcggggcggggttgccgtacaggcgctgcgccacgatgttcgtgccgtcgaagaccgcgatcttcttctgcacggtgttggaggcagcgttgaaggtcagggcatcgacgttgaacacgccgcccgagtacgcaccttcccacttgccagcggtcggcgtcggaacgtcgtagccgaggatgtgggttgcgttctgcgaaccatcggtcgccgccggatcgtgcttggcgaacaggccggaggcggtgacgcggccgagcacctgaccgccgacgtaggcgacgccggtcacgagctgcacctgggtggtaacgatgtcggactcaccagcgaagagctggatgttgccattggcgttgctgttgtcgaccgagacgccagcgatggggccaaagttggtcattgcgatgtactcctgtgagtggactaggtagccggtttttcccgtctaggctggcgacggtgttctttacttgacggccttcagcacgctcttgttgccggtggcgtgggcgtaggcaccgagcagaccgccatcggccttctcgcccttgtcgccttcgtcttcgccgtcgccgccgttattggagatgtcagcgccgccgccggtcttttccatcgccgcgtcgagcgcggacttgccggtggaggccgacgccttcggcgacgcagcgagtgcggccttggcttcgtcgacgctcatgctgctcttgaaggcgaagtggttggcgagaccttcgcggcccttcgcttcttcgcaggtggtgatgccttcgatacgagcgcgctcgttggcagcgtggtcgaccttctcttcggtcttcttctgctgctcgacggtggcgtcggtcttcttctgctcttcgacggtggcgtcgggcttcttggtatcgctcatggtgggactcctgttttcgctggtggaagagccgaagacttcggcccggaaggaagcgactgcctcttgcggagacatgaccgcatcgaccaagccgaccttgaccgcatcgtccgcgccatagacgcgggcctgcgtgtcacgaatcgcttgttcggacattccgcgattagctgcaaccacggaaatgaacttctgccacatcccgtccaggcgcacctgcatgtcggcgcgcacgttgtcgggaagcggactataggggtttccgtcgaccttgtgttcgccggagtggatcagcgaaatggcgacgccgaacttctccatcgccttgctcagatcgacgtgcatggtgacgacgccgatgctgccggaatcgccggagggggtcgacaccatcttcttcgccgagctgcccagcgaatacgcgccagacatcgcgcccgcgttgacgaccgacagggtgggcttctcggcgcgcttgctgcggatgtgatcggccagctcgaagttgccgtagaccatgccgccgccggaatggatgtcgaatacgatgcccgccacgtccgggtcggccatcgcagcgtcgaactcgcgacgaatgtcgtcgtagccgcgcgtgccgtaccacgagtcgccgttacgatgcacgagcgtgccgcgcatcgggatgaaggcgaggccgtcgctgaaggcaaacgccttggaacgctcgcgcgggaacgagatgtcgaaggcacgctccatgagcaccacctgggcctcttcagccgccgcgcgctgttcggcggtcggcggggcctgctgaagcatcatcgacgagaacatcgtcgcgatattctccatctcctgcggtgcgatcagggccgggcggccgttgaagccctccatgatcgacatgcgcatcgccagcaattcattcatcgtcgttctccgtttcggtttcggtagccgtgtccgccttggcgtcatcgttcgcggcgctgtcagtagccttctgcgtgcccggcttgctggtcgacatcgtgaagttgagcttcttctgctcgatgaggcgctgctcgcgcatgtgctgctcgaacacttcgcgatagtccttgcccagcttgcccagctcgtcttcgtacgtcgacaggcccgatgcgatgcgcagcacggcggcctgggtttccttcagctcgtcgatctggccgcgcgatgcgccgatccagtcgcacttgatgtacgcctcgcgattgatgccctcgtagaaatgcgcggcacccttcggcatcggcagatcggtctccgggcggttgatttcctcttccagccacagcatgtagatcatcgtcgcgaagcggtcggtgatgagcttcttgcgcgactgcatgaacttccacgtctcgatcatagacgcacgagccgacgagtagttcgtcttcgagtagtccttcgagaactgctcgtagctcaggcccagcgccgcgcagatgtgccgcagcagcgagtcctcgaagtcactgccgacgccgcccggctgaccggcgttttgcaggttgagcttcgtgcccgggaacaaatgcgggatacgcacgccgtcgatagcgaggttgtcggaagaacccacgtactcggccagcgcgcccatgtacttctgcaaccacgtcatgtcgccggagccgagctgcgcgaacaccatctcgcgcggcagctccgactcgatagccgcagcaaaggtcgcattgaccaccgcgttttgcagaacgatgtccttgtagaccttcgtcatgcgcatttctttcagcaccgccaccatctgcgaaacaccacgcgtctgaccggggcgcaggatgtcggcgatgtggatgacctgcgggcggccccacggcttgaacgccggaacgcgcgtccacttcgcgccgaatcggtcgtagtaggattccatcgggtgagcgtcgcggatgtggtacgcctgggctgcaccgaaacgatcaatctccacgccacggcgcaggaacgcagtgtcgctattgtcgttcggattcgacaggcgatccgggtcgatcatgttgatggcggtcttgtacggacggccgttgcccttcaggtactccgaagtcgccagcgtctcgcccgccatgaacgcctgggccagcgccatgcgcacgagacccgtcaggccgttcttgcgcgaggcgtcaatccagttcatcggcgactcggcgtacagcatgaacttgcgctcggcgatgagctggaactcttcggcccacttttcgtcgaagccgagcgagcgccagtcgggccgagcgttcaaaaggtactggccgccgacgatggagtccttgctcgtgtcgagcgcgccctggatgtagccgtcgttgcgaatcagatcgcgggtgcgcgcatccatgcgcactttgtccggcgtgatttccatgtccggcggcagcgagggcgcggaccacaacgcggtctgtcggttgaggttcttcgcgccctcgaaggcaccgccgaaaatcatgtcgttcatcgtgcgctggaaggcggcatcgccctccggagaacgtactactgcgaggtcttggctcatggtctaggccgccttaaaagagagggcgaagggggccgccgattactgcgacccccagcatggcgttgatctgagcctggagcatggcgatgtacttcagcagggatgccgggttggcccggctgtactcaacccgctccccgttctggtcgaccacgaccgtcaccgcgccgcccatcatggcggtgtgataggccgcttgtgcctccgcaagcatggcttgcaactgttcgagggtcattgtgcgtcatcccagggtggctccgaattgaccgaaaccataatccgtagtcgggcttgacgcaaacctcttttcctgatcggcaggtcgcacaagagagttgttactccactcgtcgtaccagctctccgggttgtcccaatcgaaatgctcgaccttcagaatggtgcagaggccgaggcagtagtacgccaaatcccatgcttcgttgcgtcgcttgcctgggttcaaccaacggttcttgtcgtcgcggaactccaccgtcatctcgacgtacacatagtccggcgtccacttgttgaagaagtagcgagcaccgccgtccttcttcgcgtcgagcatgccgagcaacgtgtccttcagcacgttcgagttcaagaacagcaccggcacctcgccgcgcgcaccggccgagcgatcctttcgatccgagtcggggtagtcaatctcggcgcgcggggcaccgaacttcggctcgcccttgatgagcagcactcggttgcccttggcgctatcacgcattgaccgccagtagttgtaggcgcgcgtcgtggagcctgacttaccgccggagtcgatgcctgtcatcttgatcgacatgaagccgctgccgtcttccagctcgtactccttctcgacgacctgctctgtaatcaagtcccaatcttcctgcaccgcgtacggcttgacccacaacgtatcgcctgcgtcgtccttgcgcttcgacttctggatgttgaagcggtccaccatgtacacgtcgtagcccgcgccgctctcgctcgggccgatgccgtgtacggtcacgacgaacatgttcttctgaacgtcgacggtggcgagcaggaagcgagcgccgtacggcaccttcttctcggcccacttgatcgcgttcgattgcaggtcttccggcaggcggttcgagtcggtagcgttgaacggccagaacggttcgccctggtcggtgttgatcgtggccttcagcgccttcgtttcagcggtcagctcgaacgtctgctgggcctgcaacatacgctcgacgagcttctgccacgtgatgaagcgcgcggccggtcccttcagccagaacgacgcagtgcgcgaacgcgcgccgacgccctgcttgttgccgtcgcggtcgagactctgcccatcgcgaagccacacgccgcgtcggttcatctcgtacttgtgcttcggctcgatcacgcagccgttcttcgggcacgccatgacggtcgactcggaagccgcaaacggatcggggttcttcgtgtcccagcgcagcagcgagaacttcggctcgaaccactcgccgcagtgcgggcactgccagtagaagcagcggcggtcgccttcgttgtacaggccgccaatgccgtcagtcggcgggaacatgtgcgagtccgggcgcggcggcttccacttcgggtctttcacgtcgaacgacggcgacgactcggccagcgtcatgccgaacgagccgaacgtcgtggtgcgcttacgggccagcgggaacggcgggccgttcttctcgatgtcctgcggcatgcggtcgtagtcggtgagcgcaacacgcggcaccggcttgcccgagagctggttgatcgtcggccagcccagcgtgagcatcatgccgttgcggtagaacttgtcgaagatgttgtcgttgtcattgccgggacgcagcagtgcgccaatctcgcggctgtcgcggtgcatcttgtcgatacggcggtacgagaaatctcgcgccgtgtcgcgcgcggtctggatcaagaagaagtcggccgggtcgcagcgcgccgtgtacgcgatccagttcaagatgatttcggtcttgccgccctgcgcagggccgatgaagatgcacgactcaaaatcgcggctgttgagcacgtccatcggctcgacaaggtacggcgtctcttcattgagccaggggccgacgtacgatccttcgttgtcgaggtagcggtacttcgacgctgcctgcgatacggtcaaacgctcgggcgggagcagcaccgagttcgcagcgtaggtcagcagttcgcccaggtcgttgaaggtgctctgcgcgccctgggaaagctgtgcagacgaaaacaggtcatccatatcactcatcctcgtccagtccgatgtcgtcgaccttgatgtcggcgagctgctccttgtccttgaagcctgcgtacatctcgaagtcttccacaaggcgctggcgcagcgtcgtcaacgcgacatcggagatttcgcgctcgatgatcttgcgctgttccggcgtcaggtcggtgcgtgcctcaacgcgatccgccagcaggcgcaacgtctgcgacagcgagcggaaagcgccgacgaaaatctccatgacctgctgcgtgcgccacaggtcaccggcgttctccttgtacttcaacttgctgttctgcgcgttccaatactgcgcctgcaacgcggacggcaaatcgccagggccgacttccgcaaggtacttggcgatgtcgacgataggctccacgaggtacggcgcggcggccgacacgtggtaggtgggcgcgccacggcggtcgccggtcggacgcagcgggcgcaacttctcggtgacggtgcggcggtccaggcggaacaactgcgcgaggcgcgggatcgtcatgccgttgaagaactcttcttcgtagtcgattttagctgcggacatttttcagttctctctgtacgtcggcgacacgtcgccgcatgggttctttcagggcgtcttgcgttacttctttgcgcaccagctcgcgggtcaggtcttcttcaatcgtgcctatcgcggtcaggtgcatcatgttcacgtgtgaggcttgctggcctcggcggtgcaggcgctttcgcaactgcatgtacagctccaaatccggcgtgtggtcgtaccagatcaggttgttgccgccgcgctgaaggttgacgccgtgaccgatgctcgccggatgcacttctgcgatttcgatgtcacgcgcattccaggcgtcgatgtctttcttcgtcttcagcgagcggatgttcgggaacgcgtctttcagccggagccgcgagtgctgccacgtgcgcgccacgagaatcggcgagccgtcgctaaactcgacgatttccttcatgcgctcgatcttgcggtcatgcacgtcgatgaaggtcttctcatcatctccggtgtagacccggccgcatgcgaactgaagcagcttgccgtacaacgcgccttccgagagcgcgcggacgttcgggtcttcttcctctccccacttcagcaccgacgtgcgctcgaactcccgatactgctccaagaccttcttaggcaggatgatcggcaccgggcgaggaatgagcggcggcagcttgacgtaatcctcttcccgcagcgtgtacacgatgtcggcgacgcgcttggtgatcgacttcagcgcgaacggcttcggcgtgatcttgcgccccatgaactccttgttgaagaagtgcgcgaggaacttgctgtaggacgcgaacaaacgctcgccgccgtccatgatcgccatctgcgcccacacttgatgcaggccgttcggactaggcgtgccggtgagctggatcacgtcagtctcggggcggtgcgcgagctttaccgcgtgcttccagcgcttcgacgccttattgcggaacatgctcgattcgtcgaacacaatcgcgtcccacggcaccggcttcttgttgttcttgaacagcgacgcgagacgatccagcttatgcaccgagatgccgtcaatctcgcacggccgctccaactgcatgcgcatgtgctcaggcgtgccgtcgagttcctgaaagtcgagccagtgcgtgtgctcccagctatcgacctccgtaggccacgtgtcggacaccaccagcggcggcccgacgaccagcacgcggctccactcgccggagaacaccttgtcggacacgtgcgtgagcacgaccaccgtcttgcccaggcccatgtcgacccacaaagcacaactgccgacactctcgataaagaggccagcagcgcgttgatagtcgtccagtagcgagcgttcgagtcgttccttcatgcgaacacccactcggcgaactctttgtcgaagtagtcgatcaccagcacgaccatgcccttctttcgcagctccttgtgttcttcgatctggttcgccgtaggctttccgccggggcgcttgaactcgatgaagaacacgaagccgttgcggacgaacatgcggtcgggaacgctgctgttgccgggcgaagagaacttgtacgccttccacccggccttgcgcgccaccttgcaccacttctcttctacgtctttttcgagacggtgcttgtcggttgataggatgtcgcctctcatttctgatagcactccacggtttctgccttcgcgcggatcggcacttcgtcgccccaccactccggctgtacggtcatgtcgtcttcaaggtcgcgcgctgcaatctctgcgagcttcgccttgaccaagcctacgatttcatcgtgtacgtgcatgcggatgtccagcccgttgtcccaagcggtcacgatgccgatagccagcagctcgcgtgcaatcgcctgcaccaagttctcaacgatcttgccgccgtgcgagtcgatccgcatccagaccttgcggctcttcccgccgtagccctcgtagctgaagcccttcttcgacttgtacttcggcttgccggtcctcttgtcgatgccgaccttgatctttttccacgacatctgcggacgcaggtagtgcaggtagcggccggacggcaggcgcatgcgcaggaacggccccttcacgtccatgagaatcgggccgacgcgctgcggctccttcgtgcgcatcaccttctcgacagcacgttcgaggtcgtaccagagctgcacgatttcgtcgtactcgctgcggaagaacgctaccaccgcagccgcttcctccgccgtcatctcaatgcccatgctctctgcgtagcccagcaggccgg

SEQ ID NO: 19 - DNA, 44443 bp, Unknown
  Bacteriophage Xfas301
atgtgcgtgttcgcaccgaagaagctctcgacgccgttcccgagtatcgtgacggcactgttcctgctgatgtcgctgacctcctgcgcgaacctgccggttcccagcgatgatctactgaaggactgtcacatcacctacctcggtggtgagcgcggcacgtcttccagtcaggacaaggtggtcaagctcgcgcaggaccgccgcatggacaccgttctgtgcaacaaggacaaggccgcgctgcgtgcgtggaaggaagaagtgtgcggtaccggcaagcgccggtgtacgggtgacaaatgaccaccatcgcatgggacggcaagcacctgtgggccgatagtcaggccacgcagggcgaccacaagcacaccgtgcgcaagatcatgccagtatcgacacccaccggccctgtgctgctgggtgtcaccggggatttcacagtgcttcgcccggttctcgctgcgcttaaagcgggcgaaggctacgaggagcacgttggcaagtccgcgacggtgcttgtggttaaggacggcgtactcacggtcactactggcaagcagcagtgggtcgaggaggctccgtacttcgatggtagcggtaaggcgttagctctaggggcgtatcatgcgagcaagtctgtggctaaggccatggctgccgcgatagctcacgacgtgtacagctccgggcctatcgtcaagctaaaggcacccgttcgcaaggcttagtcataaggccacgtggatagccgaccaaaatttgcttcggaaatgcgcgggggtcactccaatagaagctcccgcgcgtgcccccatacgcccgtgcgttacgcgcctgcgggtgcgcctgcctgcgtgctcgcgtgtgcgcctgtgtgcgcgtctgtgcgcccgcgtcaaggttccgcgtgggtgtgtgcctgtgcctgcctgcgcggggcgtgtgcgtgcgcctgtgcggccgtgcgtgtgcctgcgtgggcgggtgcgcctgctgcctgtatggctggaccgtgcctgccttggctgaatggttaataaatctcttgcagattgtgcttgacgggtggccgggagtgtggtctactggcgtcactggggcagcgacagggcttcaggagggccgcaaggggcttgacaggtgcatacctacctgctaccatgcgaaccgcagctgtaggcgtgtgagggccatctgtatcgtttcggccttttggtacacctatagcacacagtgccgtcgatcctgaacgccgagctatcggtactctgtcgaggcatgaagtgagccacccgctaggccaacggttgacaccggccctgcaacgtggtaagctgattcggaagtcgagtgatgtaggccgtagtggcgctgccaacaagcgagctaagggtacatgggtgctactggaacgggatgcgaggagctaccgaaccacacttgacagtaagccgacagtgagctatgatgtaggcaagtgatcgagccaacggtaaggcggctggaccacctagcaagacaacgtaggcgctgccctagccggacacacgatagggcttgacaacgaaccaccggtgagctaacataggcaccacggtctgaggaccaccggcaatggaccgggcaggactaccgctaacgggtagggtgtaacgggaagcccttacgggtggaccgccaagctgcaacgtagcactagcggataaccggatgaactgggatgtaaaaggcccatagaatccaccagactagcaacactggtgccgctttacctagagctaacgtctagggtcagcatctgccgtgagagtcggccacgctgataacctactgccaaggtaggaagccggtcataagcgggtggtgagcctgctatcgaggggcatacccttcgtttcgtgaaagcttcgggatcggccacggtgacaatggcactgctagccggagtagggttgacagcccgaagggctagcagattgatgcacactcacggtctaagacacgcaccgctttaattgccttgacggcagcggggaggacagttacgaccgttccatcgcaactggttaggctaccggttgttgcgaccggccctagagtgtgcatcaatctgttagttttcccaccagtgccaatggaggcacacatgcaaggctcgaccaatgccaatctggaacgcacccgcaccaagcgccgcttttgccagttcacccggactgcaagcgtgatggacctgcggactaccgagcatgaccgcaagctcgccgagcgtaagcgccaagccgaacgatacgaagcccgccacggaaccgctggaaagcgatctgtgtttgctgtcgagggcaacagcgggaccaatcgagcgaaccacgccgctgatcggagggcctacctgtgatccgtttctacttcgccgcagggtacagcaaggccgcgtgggaaagccaccagcgcgcattggtcgctcactcggagacacccgccgccgtctccgacctgcgatggaccggcgcacgctggacctacgacatcaccctcgccgcacctgcgatccactgaatgcaagctactgggccttcgcaagagggcctagtgtcgtgcaatcggcacggacccaacctaaagggaaccaccatggacatcatcaccggaagcgctgacatcaagcgcgccatcaagtcgatcaataccgctcgcaccaagctggtcgatcagattcagcaggccgccatcgcggtcatcaaccacgcacacatccacggcgacgttacgctcgcttccgatctgtgtctcgccgtgggcaacggcatgaagcatgaagccctgcgcctgtacctgtccgagttcggcccgatggctccgaacgacgacaaggaaaccaaggcgagcgcgcccatgaagttcgccaagagcaagcgcgtcgagggcgaagctctggccgacgtgctggaacgtgccgccgcgaaggcgtggttcgacttcaagaccgagaagcccgccgaggcgttctcgttcgccgccgacctgcacaagctgctgggccgtctggaaaaggcaaccgaggagggctacgtgccgaccgaggaggagcaggccgtcatcaacgctgcccgcgccgtcccgaagcctgccaagaaggtgaaggcgtaatgcggcccggcacccgcgtcatcggagccggtgtgcgtgggtgccgctgtctgaccgagggcaaggaatacacggtcgaggactaccagcccgcctataccgacccgacaagcgcgagcggtttcacgtggcctgcctacgtgggagtcatcaacgacgatggccgactcgcctactaccacacccaccgattcaaggagaaagccgatggaacccaagatcaacctgcgcgtaacccagcgtgaggcgtcgttgctacgctcggccctgcacattgcctgtgcgctgactgccaaggccgacccgtatgccaaccgcaagctgtccaacgagttcgccgtgctgcatggtgagctgcgcgacttcggtgtcgagagcttcgagcgtgataccatcctgaagttcgaggacgacgtgattgcagcctgccgggacagcgatgtcgaggcgcagctgctgcgcgacctgttcgctcgccctctgactgtcggctacggcatgcgtgagatggactacgccgctatcgaggcccgcgtgatggcctgcctgctcgatccgatcccgccgctggtgatcgacgcatcgcagctgccgttcgagttcgtgggcaccgtgaccggccgcagcgtgatgtccggcccgtccatgccggacaacctgccgcgcaagctgcccgacgtgctgatggacgaccagagcgcacgacacgtggcgctgaccgcatcacagaccgggctggtgaacaaggccgagccgaagggctggatcgtgcagttcaatctgcgccatggcagcatcgccctcgccaactgggcgcaggtgcgtgagctgggtctgccgcagcgcagccgcaatgcagcgtaccgtgcactgaaggcgcgggccaaggcgcagggcatcgccgaggacgcctaccgtgtggtgcctgccggtactcccgatggcccggagaaggatcgcggcttctacaccgccgagttcttcaccaagcatgccctgcgtccgcatcagcttggctggaatacgtccggcgcacgtggtctgaccggcactttcccgactgcgcaggccgcagccaacgccatcgaccagcacgtaaaggacaccggcgcatcccgcagccgctatcgtgtgaagtggcacaagaaccgcgcgtgatctaccgctgcgccttctaacgagggcgtagctttggaaccacgcccaacaggagggcacattgcatgatccccgtaacttacaagcgcatccgtagtgggaagcgcaagccgatccagctgtgcgagaagccgcgccagtggaaggagttcgtgacccatgagcacagcgtggagcgctggtatgcgtgaggtcagcctgcgcctagtggtgaaggcgctgcctctcgttaccgtgaagggtgtagctgtcggggattacatcctcggcggccaccacaccagccacgaagcgtgcgagcaagccatcgcacaccaccgcaagcaccacgagaaggtgcccaccctctacaccgtagaggaaatcgaaatcccacccgtcaatgaggagaaccaccatgcgtaagctgtacttcatcgcttcgatcccggccaccgcgaaggatggcgtcatcactggcgtcgtcgccaacggtacgggccgcaaggccaccgccgaggaagtgaccacactggtcgagctgctgcgcaccaagggtgcgtcccagtccctgctggatgcgctgcgcgatgccacctatccgggtccggtgtctgccttcgaccgccgcgctgctgcccgtgccgaggcggcaaccctgaactcgttcggtggtctgttcgtctggtccgtcatcgagctgggcgagagcgtgcgtcagccggtgcgcaagccgctgggttggcggatcaagtacgacggcgggttcaccagctgctacaaccacccgaactacaccgcgaccgtgttcatcgacggcaactcgaagaacaccagcgaggacaacgtgctgtttgccacccgagacgccgcgcgcacggccatcgagaaccacatcggtgacaagcgcagccgcaagaacccgcagggctactacatcgagccggtctatgcgtaagctctggctgcgcatcctgatcctgctgtgctggatcacaggtcgtggcccgtgggttgtcgtcggccagtaccatgacgacgacggtaagctgtgccggttccgcaccggcccggcttccaccgggttctcgctgacgttcgatgacctcgacgcagccaacgactactgcgaccagcgcaactggaaggcagacaccgacccgctcggcaccacgtactacgtgtggcacgatacggagttcaaccacttcggacacaggagaaagtgaccatgggattcctcgacaagatcaagaagggcgcgcagtacatcaaggacaaggtggtcaaggccatcatgcccaagcgcgacgacgatgacaccaccccgccgcctccggtggacacgagcaactacctgcacgtcagcgtgccgctgatccccaccgacaacccgatcctgcgcaagatgctggggcaggactacttccccgtgcagaaggggcagggtcagacccggatcgtcggcaacaaccagctgaagcgcgtggccgatagcctcggtgccaacaacaaggaacgtcgcaagctgcgcacccggatgaagcgccgcgccgccgagctgcgtgccggtgcatcgttgcagccgaacgtgcaggccgcactggcaggtgcagcatgagcctgcgcatgggaagctgggtcgaggtgaccgtgcccgacagccgactgctcaacgtgcagccggagattgccgccgccgtcaagctgatcggtggtgcgacgatgaccaatgcccgtggcctgtacgtccgcaaggataccggcgcactggatgacgaggcggtgaccgtgatccgcttcgacatgaacttgcagagcgagctggtggaccagtacatgagcgcgatccgcgcaatcgtggaccgcctgctggtgctcggcgaggagagcgtgctgcgccgtcgcttctacagcatgggcggcgggtacaacagcgagctgatcttccagtaagaggaggcgcgatgcgtatcagggacggcccgacgtaacgcccaccaattattgaggatcgttgggagcgcccgcctcccttgattaacgggcaccatcactacatcaaccgtcaagaggaaccatctacatgtcgaacgaaaacaccaccgagcagaccaccatcagccactacgaagccaagcgcgccgagctgctggaagacatcgccaaggcgcaggccaaggtcgatggcctgaacgagaagctcgccaagctggatgccgtcgaagccaacagcgccgccatcgaagcgctgtccgctggtgacgccgtgtcctacgtcttcggccgtgctctgaacaagcgtgtgctgtcgggcgtcgtggtcgccaccggcaagaacgacaagggcgtgctgcaactgaaggtgcagaccggcgaaggtctggatgccgagctgaacctgatcgacagcagcgccctgctgatgtcggccgaggaagtgctgaaggcgcaggaagaaatcgacaaggccatcgccgaagcgcaggctgctgccgctgccaaggcgcagggcgaaggcggtcagtcgtgagccggggcagcaccagcccggcggtgccgccgaccagcgcgccgagccgcagccagttcaccgcaggccgtgacctgaaggtcggcttcaactaccgggccatcagctccggtgctggtgaagtgatcgacggcgacacctacctgctggtcaccaacgtgaccgacaagaagggcaatcgtcagctggtcaacaccagcaccggcgaggtgtccttcgccacgcccggctccatctggagctactgatccgacgaggatagcatgagcgatacccttcccgacaacgactggctaccacacgccgagcgcctgcctgttggtggccgcacccgagtggcccatgagtgcggggagggtacgcccttgctgattactcgtgagcatgacaagtccaccgcattctgtttcaggtgcggtggcacaggattcaagcgtgagcacgagagtatcgaggccaagcttgcgagaatccacgccgagcaaacgagcgagcgcagagtgcgcgcaactgttgagttgccagagccacgggtatacgacacccgcgagtggccgctcgacgctaaggtgtggttcttcaagatgggactctcgcttcagatgatcgagaagctgcggctgtactggtgcccaagcatcgggcgggtggtactaccgatcactgaaggcgacaacgtggtatactggacagcccggtcggcaacgagacagccgaagtggctaacacctgacgttccgaaagacggacttgtcgcacgctacggcgtgggcacaggtgacaccatcgtactgtgcgaagacccgctcagtgcatacaaggtgggactggtaaccgaagcgtggtcgttgctcggcacgaagctgcacaacaaagtgttgaagcagctgactgatcgaggccaacgtgtagcgacgtggctcgatgacgacagaggtagaagcaacggtagcaatcccggccaagacagcgcgcgagtaatcgctgcgcgtctacgtgcgtttggtctggactacaggaacatcacgtcaccacgtgacccgaagtattacacgaccgactacatcaaggagaagctgcaatgagcaaacccatcgtgcgctaccggcgcgctatcatcccgcctgtcgttggcttccgtgccacgctcggcggcgtgcttgcgcatccgaacctcggcgactgcgacatcgtgcacacctcgacggtgctgtacgtgacagacggcgggcgcaagttcgagacacgcaacacccggtatcaccagctcgattcaaagtacgaacccgaaggagaacctgatgagtcttgacaccacgctgctgcggttgtgcaccaaccgtggcaagttcgaccggctggtacccagcgcaccacgtgatgggctggacgagctgaccgtgctgatgctcgatgcgttgcgtgcgtactacaaggagttcccggacacgaaggacttgccgttcgatgtgttcgatggctgggccatggagttcaagtggaagacgcagcccgacgacaagaagtccctgctgaaagttctgctgaagcagatgcgcgagccggtcccgcccgaggcagagcagggcatgatcgagaagctgttggagttggagcttgccaccactgcggtcagcaagatcgtgcagtggaatggtggcgctgagttcagcctgcgcgacgagcttgccgggttggctgagacgatcaccgaccgcatggatcgcaaggcccgcctgccgctggtgcaggagacgcccgaggaactgatgcagatggacgagcacgacatcggcatccacttccgactgcccacgttggcccgcaacctgcgcgccctgcgtggtggtgacttcggcatctacgccatgcgtcccgacgcaggcaagaccacgttcctgaccagcgagtccagccactggatcacgcagctcgacaacgtgtggcccgaccagaagcgcaccggtatctggctcaacaacgaaggtccgggcaagcgcatcaagcagcggtggtatcagtcgttgctcggtgctaccatccccgagatggtggagtgggcgaaggacgggagcatccgcaagcggatcgaggatgcaatgggtggtgacctccaccgcatgcagttctacgacatccacggattcaactccggcgaagtcgaagccatcatcaagcagaccaaccccggcttcatcatcttcgacatgatcgacaacatcacgttcaccggaggcatgaccaacggcggacagcgtaccgatcagatgctcgaagcgatgtaccaagccgcccgtaactggtgcgtcaagtacgacgcagtgggcgtggcgacatcgcagatcagcgccgagggtgagggcatccagtacccgccgcagtccgcactgaaggacagcaagacgggtaagcagggtgcgtgcgacttcatcatcatgggcggcaagctcaacgacccggcgatggaacgcttccgctacatcggcacaccgaagaacaagctgcaccgcgcaggcggtaagcgtgacgttcgtgaggaggtgatgatggatgccgagcgcgcccgcttctatcaggaggcagcatgagtcagacgaaagtggaagtgcacgggcaccgtgtgttcttgcccggcatccagaaaggattcgacacggtgtccagcagtcaggccaactacctcgcgtccgtcgtgagggatgcggtcaacgctgcatacatcgaaggacgcaacgatgctccgcagtggaagtggggatggttgcgcaacaagcacagcacatggatcggcgtgcactactcgccgcacaacaagcgctggtgcatcaacctgatcccatgcttcacgctgtggatcaccaagcccggaggtaacacaccgtgagtaccgagccgaacatctacctgccgcgcaacgtgggcgtaatcacgtccagccgcaccggcagcagctacaccgtcgagcctgccgtgaccgacacggacatcgacttcctcgtgctggttcaggatttccacgaggccatcgccaagctggtcgagcagggctggaccttgtgctctggtgctgacgggcactacgaggaagacgaggactacagcgacacgtggtacgctctgcgcaacggcgtgttcaatgtcatggtgactgccgacagtggctggtatcagcgcgcggtcgaggccaccaccatctgcaagcgccgcaacatcaaggacaaacaggaccgcatcatcgtgttccggtgggtgcgcgatgggctggacttggatggcgatgcgtcggatgaaatgtaccagcttgccctgcaacggtggccgctgtgagcttcacttccttcgacctcgaaaccacgatccgttccatcctgaagcgcaaggccaatccgttctacgacatgaacaagatcgtggcgattggctacaagcgcaagggtgacgcacggaacaccggcctgtactacgacacccgcatcggcatcgacaaccagtacatgggcggcgcacctgacgggtggctgcgcgagctgtgttacgggcagcagttcctcgtcgggttcaacatcaagttcgacatcctgcacgccatctgccaaggcccgctcaatcggcaggcatggatcgagttcatcgacggcggcggcatggtgtgggattgccagcttgccgagtacctgctgcacggcatgacgcaagagttccacatggcgagcatggacgagacggctccccgttacggcggcaacctgaaggacgatgcagtcaagtccctgtgggctgcgggagtggacacctgcgacatcgacaagacgctgctgatggattacctcctcggcaccaacgacaccgacgacgtgggcgacatcggcaacaccgagaagatgttcctcgggcagctcgccgccttccgtgcacgtggtggtctgcgctcggcgctgctcaacatgggcgcgctgtgcttcaccatcgaagccgagtacaacggcatgtacgtggacaaggaatgggcgcttgcgaaggcgaaggagttggaggtcgagcttgcaacagcgacggctgaactcaacggcttcatccccgagttgcccgagggcctgaccttcaactggaacagccgcttccacaagagcgcgctgatcttcggtggcaaggtgaagtacacggccaaggttccgatcatgtccaccgagggtgggccgacctacgtacagaaggacgaggtgcactatgtgctggtcgatggtacaacgacggcgacgccaccggccgaggacttcgacaacctgtggcggtacaccacctacggcagcggcaagaacaagggcgagtacaagaccaagaaggtgaaggtcgatgacttgaccaagcagaagttccgcaacgaggacatgctgttcgagttccccggctacaccgagccggatgctgcgtgggaaagcaagagcgatccgggtgtgtactccaccgccgccgatgtgatcgaggcgctgggctatcgcaacctgccgttcaccaacgcactggcccgccgcgccgacatccacaaggacttgtccacgtactacatcacgacggacgagaagaccggcgagcagaagggcatgctcacgctggtgggaccggatggtatcatccaccacaagctcaacatgaccaacacggtgacgggtcgcctgtcatccagcgatcccaacttgcagaacgtgcgcaagggtgagctggacgaggagacgttggaggagaagggttctcagatcaagcgcgccttcgtgtcccggcacaagggtggcaagatcatccagtcggactacacctccctcgaaatctacgtgcaggctatcctcaccgagtgccgtcagctgatcgaagacctgaaggcgggcctcgacatgcactgcctccgtgccgagcaggcgtggggcgagcagggcaagtacgactacgacttcatcctgaaggcgagcaaggacgacaagcatcccgagcacaagaagtggaagaagaagcgcggcaacgcgaaggtgttctccttccagcgtgcatacggtgcaggcgtggcgaagatcgctgcgaccaccggcatgacggaggaggaagtcgaggcgctggtgcgcggcgaggccgagcggtacccggaactgggtgcttacatcgaccgcatggtcgaggccatcaagcgcaaccgcgtcagcaccaaccgcttcgttccgcaccccgacgccggacggcagggcgtgcctgctgggctgacgtgtcagctgggccggtcgcactggaccacgccggacggcaagatgtattccttcagcgagtcaccgtccccggtgttcatcgccaacaagcccgcgagcaagggcggctgcgcgcagtcgttctcgcccacggaaatcaagaactacccgatgcagggcaccggtggtgagtgggccaaggcggcgatgtacgtcagcctgcgcgccttctaccggaagtacgtgaccgaaccgaaggagtggttgggccgtgcgttgctcgtcaatcaggtgcacgatgccgtctacgtggatgcacatggcgacatcgcaaccaaggccgctgctctgctgcacgcctcgatgctagaagcgtcggtgtatatggagtggtggttcaactggacgctgccgcttggcgtcccgtgcgaaaccaagatgggcgacaacatgatggaggagaagaatcctcccgcagagttcgccggtctggtcatcgagtaccgagcgtcgatccgcaaggacttcgtaggtaatcacaacccgtcgtttgaataaggagaacaacacgcatgagtcttgacgcactgttgaacaaggtcgccacgcagggtaaggaccagtcggtcgccagtggtggcaacttcgactacaccccgcccgctgccggtgtgaccaccgcccgcatcgtcgggtactacgagctgggcaagcacgagttcgagttcgagggcaagaagaagacgcaggatgaagtcgccatcgtgttcgagctgaccggcaagcagcacccgcacatcgagacggacaatggtccggtcccggtgcgcatgacgctgacgctgggcctgtccaccaacgagaaggcgcactacttcaaaatcttcagccgcctgcgcaccgaggagcgccacttcgtgcagctgctgggtcagggtgtgctgctggaagtcatccacaagccgggcaagcgcgacccgaacaagaccttcgccgagatcgacaaggcttccatccgcaagccgatcatgccggtgccggaaatggagaacggcatcccgaccggcaagttcgtggacaccgtgatcccggtcccgcagcagatcaccccgctgggtgcgttcgtgtgggacttcgccgatgccgaaatgtgggacagcatcttcatccccggcgagtacccggagcgcaaggacgagaagaccggcaaggtcacccacgaggcgcagtcgaagaacaagacgcagctgcgcatcgctgcggcgctgaacttcaagggcctgccgtgctacgactacgccgctgccaagttggcgggcagcaccacggtcaccaaggaaggcgtcgatgcgctggacgaagtggtcggcgacgtggcgaacgctgcgcccaccgacgctgctccggccgacgacaagccgccgttcccggtggacggtagcgacccgatggcaggcatcgcctgatggacctgagcgctctcatggctgcggctggtgagcgctccccgatgccggtacaagtggtacgtcaacacaatccccgcgtgatcgctcacgtggatggggactacatggcgtacttcgcggctggtagcgagaactgctcggcgggggatgcacggcgcaacgtgctctcccgctgcgcacagctgaagcatatcagcggagcgggtaagatcgtcatgcacctgacgcacggcgcatccaccaagggtgaccgcttcctcgctgctaccacgcagccgtatcagggtcagcgccaagcaggccgcaagcccaacaactgggcgttccttcgtgagtggatggagacatacgagggcgacgctttcactcccaaaatctggctgacgcgagaagccgacgacggcatcgcatacgtcaacgagggtgcagcattgcaccacaacatcctgcacgtggtgcacagcgccgacaaggacatgcgaatgttctgcggcgtgcatgtagactgggaaggctacggcatcaccgaggttccgctcggcgcttacgacatcgtgggcgagaacgggttgcagtacggtcacaagtggttctggatgcagatgctccacggcgacaccgccgacaacatccccggtctgccgaaggtaggcaaggtgacagcggagcagctgcttctcgacacgaaggacaacctcgaagcggtgcagctagtgagcggcaagtacagcgaagtgctcggtgccgactggcgcaagacctttgccgaacaggccgtgttgctgtggatgcggacggatcgtgacgctgaactgctggacgtgctgaagctcgacgtgttcgggccgcagctgaagcaagcattctacgacctcgccgaggacgtgaacgagaagcgcgcaatcttggaggcatacaaagcatgaagcgactcactgcaacgcaggtcaagctgttgcgcatcaagctcgcagcggagcaagggaaccgatgctgtctctgtcagggacagttcggcctgaaggctccgctcgatcctgtgctggaccacgaccacaagaccggcgctgtgcgcggggtgctccatcgcggatgcaactccctgctcggcaaggtcgagaacaacgcaggccggtatggcgtgcgcgatgtgttcgcattctgtgcgggcatccccaactacctgcggtcccacctcaccaacatcacggggtacctgcatcctacctacaagaccgacgacgagaagcgcatcgctcgcaatgcgaaggcgcgtaagcggcggtcactcaacaaggagacaccgtgacccttacccagttcattcgccgagcaccgaagcgcggcccgaagattctctgcctcgacatcgagacgttccccatcgagttctacggctgggggatgttcaacaacaacttcagcgtcaagcagatcaagcgtgactggtcgctgatgtcgttcgcttgcgagtggctggacgatgacgagtcgttctatatggaccagcgcaacgtgcgtgatgtcttcgatgaccgcaagcagggcaaggcactgtggcacctgctcaacgccgccgacttcgtgctagctcgcaacggcaagaagttcgacctgcgcaagatcaaggcgcgcctcgccatcctcggcctgccgcccgtgtcgcccgtgcaggtgatcgacccgatgctgctgaaccgcaccgagttcgccttcacctcgcagaagttggagtacaccaccggcgtgatcgtgccggagctgcgcaagtacgaccaccacaacttccccggcttcgacctgtgggtggcctgcatgcagaacctgcccggtgcgtgggacgagtgcgaagcgtacaaccgcatcgacgtgaagtccatgaagttggagtacaagaagctgcgcggttggtactcgcagcatccgaacgtcgccgtgtactacaaggccgatggcagcgagcaccgctgcaacaagtgcggctgcaacgaaatgatcccgcaggatgatccggcccgcacacaggtcggcacgtacctcctgcttcagtgcaccgtgtgcgacggctacagtcgtgggcgtaagctgacgaccagcgccgaggcccgcaagcacatcaccgttccggcataaggagccgacatgaagatcaccgacatccgcagcggcatgcgggtacagtacaccggaaatgcgcccggcctgatcgggcggcgcgggaaggtaagccgcgtgttcgctaaggatgtcgaggtcttcttcgacggacgtgtgagcgcgagctactgcgttcccgattccctccgacagcttatgagcatcggaggtgtgaccaccaccagacgagaggtacccatgcccgaactgaactaccgcaacgaggacgagcgcacgctgtccgaccgtggcgtcggcctgaaagatgacggcggcaagccgcaggctcggctgctgcatgagggcgtgcctcgtgcactggcccgcgtcatcgacaccttgaccttcggggcgcagaagtacaaggcgcactcgtggcagcatgtcgagaaggcgctcgaacgctatcaggatgcgagctaccggcacgacaacaagcgctgcctcggcgagaagctggacccggagacgggcatccatcaccgcgcgcaccacatcatcaacgagctgttcctgttggagttggaactgcgcgaggaggagcaggcccgtggcgcagagtaagggtcgctcgatcaaggaggcgtgggtcaacatcgccatcgggtacagcatcaactactgcgcgaacatcgcgttgctgccgctgctgtggcatcccgaacacccgcttatgtcggcccacgccatcggcgtagccttcacgcttatcagcttcgtgcgccagtacatcatccgccgctggttcagcaagggtgactgatggcctgcgcccgctgcggccaagtgcaccggtacgtcccacatgaggccgagtgggcgcgcttcctagaggagcatcgtacccgcaagcagttcgatgtcgagtgggccaactcactctggcatcgcacataccctgacgacgccttctgcattcttgtgatgaagggccgcgcaggtttcgttccattcccgtcgaaggagaaatgaatgctctacaagaaccagaccgccatgcttatcaagtcctacgagaacaccgtggcgtggggcgagagtgccgaccacgaggaggcgttgcagaacgcggtcaaggcgggcttcccgaacctgccggaagaagatcaggccgagctgtatacccgcatcgccgatgcgtgggaaggctaccgtggttcgctcgctccgcgcaagctgtggatcggcaccatcgtcaaccagttcatgtcgtcccgcatcgcacggttcaacgccgcactgggcgatggcagcaagaaggaggacagcgccgatgtttgacatcaagcgagataacgtgcgggtcgctcccggctacaagaagcgcaagcgcggcttcaagatcaaccgcgccttcaccaagggcaacttccgggtgacgtggtacgacggcaaggccacctactgggagcagtacgtgccgtggtacaaggtgccgctcgccatgttccagatttggagggaccacgcatgagctacatcgtccacaaggcagtcgagcaggacaagatcaagaagaagctgcgtcccaccgaggagcagctgcgcaccgagtacatcgcacagcccaagtacgacggctgcaacatggtcgccatcaagcgcggccactgggtgcccaccgtgaacaagggcctgcacgccatcaaggtcggcgacgtgcagatgcagcccgtggatcgcggcgtggtggacctgttctcccgcaccggcgagcaggtggtcagcgcgcaccacatcgagaacgctctcgcttccgcaccgttcttcccggtcggtgtctacttcggcgaatactggcacccgaccatcgaccagcccaccgtcagcggcatgttccgcaagaaggacggcacgcagtacaccgagccgatgttcgtggtgttcgactacgtgacgctggaagaatgggagcagggatacagcgacctcgtgtatcaggagcgcgtcagccgcctgccgagcatgggccacgccatcgccgagggtaccgctcccgtgttctacgccgagtcgcagggcttcctgatcgaccaagagctgggcagcatggaggcggcgaagctgctgtgcgagggtggagcatacgatggcctgatcctgcgcaagccgagcggcaagtgggtgaagggcgacaagggcacgaacggcgaagtcgtcaaggtcaagcccacaatcacgctggacctccgcgtcgaggacatcggcgtcgaggttggagagaagaccggccgcaacgtctacaccctgtgggtccgactgccgaacggcaaggcgcaggaggtgggaagcggcgtgccgcaccatggcaacggtgttccgaaggtcggcgacatcgtggaaatcgaggcgatgtcgtacagcaagttcggtctgctgcgcgagccgcgcttcaagggaatccgctacgacaagacggaggctgaccaatgagcaacgtcaagaccgaggtgtggcacaacatggaacgcgacacagtggaggtgcgagtgagcatcccgttccgcgagtacgccggttccttgtggccgaacgagacggtgcgccatgcggtgatcgaatcgctggatcgcttcctcgccgagcggaggggctgatggacattcgattcggaaagcccgagctggatttcggcggtgatcgcttcgctccctacggtggaggtcatgtaaccgtgactgccactgcgtggtgcggcaccgagcagttcttcaaccgtcagtgcatcccgagctacgaggtcggcggcgacgcatggccgcacatcatcaacgaaatgcacaccgcactggtctgcatgatcctgaagcgttacccgccgacggacttcaccatcaagcaacggaggtagcatgctctcgcaagtggaactcgaactggaaacctacgccttcggtaaggagcgcatggagaagtccatcgcccgcaacgaggagaagggcggcgcggacaacaacccctacgcccaagcagtgtatcgccggttcgtgcttccgcttgcggagcgcatccgtgcggacatcgactccccgcgcatcggccgcgcccaagcgcacgtgccacttctgcgcgccaagtacgatcccgagcgtcagaacaagcgtggacaggccatcagcgccgaggaacaggcccgcgagtggtacgaggctgtggccttcgtcgccgttcgcggtgcccttacctcttgcatgcgtgacaagcacggcgaaggcagcgaccgcgacgtgctgaagaacgtcggcatcaacgtgtaccacgagtacctgctgacgcagttcgccgacgcagagccgacgctgttctaccacctgatgaacgacatggaccgcaagctctctgtcaacgagaaccaccgcatgacggtgatgaagatgcagggtcgcaagaacggcatcgagttcgtggagtgggggcaggcgcagcgcgatcaggtcggcgcgtacctgtgcgaccagcttgcacagctgggcatgttggagattggcgtagtcaccgagactgcggccagtgccggtgcagcgtaccggaagttccagaccaagacgcacgtcaagatcgtgctgaccgacgaggtgcgcaagctgattacgcagatcagcgacttcgtgatcgaggccacgccgttctacctgccgtgcgttgagccgccgatggactgggtggacatcgacaacggtggattccacacgaaggaaatgcggcggctcaatccgtggatggtgaagacctacgctcagacgcgcgacgagtaccgcgccgccgagctgcgcaacgagatggctgcgatcaacgcattgcagcgcgttccgtggcgcatcaacaagcgactgatggaagccgtgtcggccatcgccaaggtgcacgacatggaggaaatcatttcgcagggcgagctgccgaagccgcgaaagccggagtggttgaccaaggacatgaccaaggaaaccatgtcccacaatcaggagttggagttcaagcagtggaagcgcgacatggcgaactggcacaccgacgagcgcctgcgccagaacaagggcaatcgcttctacaacgcaatgaaggtggcgcgtaagttcgctgagtacccgagcatctacttcgtgtacttcgcagacttccgtggccgcaagtacgttcagaccaccggcgtgtcgccgcagggttcggacttgcagaaggcactcttggagttcgccgaaggcaagcccttgctgacgaaggacgcgcaggattggttctgcatcacgggagcaaaccgatggggttacgacaaggcgtcgttgccagaccgagtgaagtgggtgcgcgagcatcacgaccagatcatggccttcgctgcggacccggtgaacaacgacgagtggaagacggccgacaagccgttgcagtttctgagctggtgcatggagtacgagcagtggcaagtgttcggggatcgcttcctgagccgcatcgcagtcgggatggatggttcgtgcaatgggcttcagaacttctcggcgatgctgcgcgacgcagcaggcggggtggcgacgaacttgatcccggcaccgctgccgaatgacatctaccagatggtcgcagaccgcgtgactgcgatcctgctgggcgaggaggaagacgccgaagggtaccgcacgctgtggctcaaccatggcctgacgcgctcgctggtgaagcgcagcgtgatgactctgccgtatggctcccggcagtcctcgtgggcggacttcatcatcgaagactacctgaagtgcggcaagttccccacgctcgacaaggccctgtacggcccagcagcgcgcttcctgagcaagcgcatgggtgaggccatcgccgacaccgtggtcgccgcagcgggcgcgatggagtggttgcagcgcggttcgggtgcgatcctcaaccaagggtacgaccgcatccggtggatcacgccgtccggcttcccggtggtgcaggtgtactgggaatccgaggagcaccgcatcaacaccaagctgtgcggtaacgccaagctgtccctgcgcaagagcacggacgcggtgaagaagtcccggcatcgcaacggcatcgccccgaacttcgtgcacagcctcgacgccagccacctgacgctggtggtcaacgccgccaaggccgaggggatcgacgccttcgccatgatccatgacgacttcggcacccacgccgccgacagcgcggccctgtaccgcatcatccgggaggtgttcgtggcgatgtacgagcggcacgacgtgctctcggccttccactcagcctacccgttcctgccggagccgccgccgatgggcgagctggacctgcgccaagtccttgattctccgtacttcttcagctgacggagtttcagtacacctatagcacacaggccaaccgaggtccggttggagcggccgcgattgtaagcggaaccggtgccggaccttttggtacacctatagcacagaggagacaccatggccgaagacgccaaagtgaaagtcctgatgacgctccacccgaaccagcttgccgccgtgcggcgactgtccgggctgtcgctgtccgtcaactcgaataccacgcccttggaggcaggtatgcagttggggatggcccgcgtcctgaacatcttacaggagggtttcaccgttgatacctccgtaccgaacaccaacgacgggtgatagtgagcagatcaaggcggctttaacggccgctttgtatctgtcatctagagaagatagtaaggtagacaacagagagtcttctgtaagctacaactgtgatgatcctgattatacagtagctctgataactcagaacttagtagatgcagtcatcatagatgaagcctacctgctatgctttgccattgtcacaccgtggtattccaagaaccgtactacgttcgttgagaacatggtgctgcgcattgggccgggcagttccttcgaccggtacatagccgtgatggaacatctggctgacatcaaccactgcgactccctgagcgcaggcggtgcactagctcggaactcccgagcactcacacggatgtatgcacgctacggctacctgctggaacggcatgctccccaattcaccaagcgaaggagttaacctatgggtagcatcgttggtggtgggtctgcaaagaaggctgcgctgaagcaagcggcggctatcgacaagcagaccaacctccaaactcaatccacgaactaccagattcaggcgatggccgatcagatggcgcaggcagctgcacagcaggccgcatccgagtacgccgagaagttgctgagtgcccctgtcgataccgtcgatgtgcgactgggtacttctgacctcgacttgcagaccgccgacctgatcggccgacgcaagaccgcccgctccacctacacccggcccgtgaccacgaccgcagcttcccggctgacgaccgtggccgggtcagacctgttgtgaggtgagcatggaccattcgatccaaaccgctcaccgccagttcgaggcttacgacaacaagcggcagggcatcatgtaccgactcgaacgctattcgagctggaccgtccccaagctgttccctcgcaagaaccgcgatcaggacaccgagccgctgacccacgggttccagtctctcggcgcacaggcagttaaccatctggcgaacaagctgatgatgtcgctgttcgcaccgtcccgaccgttcttccgattggagctgaagcgcaaggcgaagcaggctgcgcaggaacagggcgcggacttgcaggccatgcaggcaatgcttgcgaaggccgagcaggacgccagtctcgaactcgacaagcgctcgatccgctcccgactgtacgacctgctgaagatgctgatcgtgctgggcaacgccctcatggtgttggagaaggacacgatccgcgtgctcaacatgcggcactacgtggtcaagcgcactcgcactggcgaggtctacgaactgatcctccgggagaaggtgcacaagacccagctggaacccgccgcactcgctgccattgtcgcacacccggacttcaagcccgatgacgacggcatggtgtgggagtacaagtgggtcaagctggaccacaagaccggcaagtacaacgaagacgtgtggatttgcaactgcaagctgcccgcaaacttctcctcgacctactccgcagacaagctgccataccgggcggtgagttgggacttggccgcaggcgacgactacggctccggcttggtcgaggactacgaggcagacttccagtctctctcgatgctgtccgaggccgcagtgcagggcgcgatcctcgcatccgagttccggtggctggtcaaccccgcaggtcagacctccgtcgaggacttcatggcatcgcccaacggcgcggccatccccggcatgaagggcgacatcgagctgattaacgcaggcgtcgatggcgtgctgcaaaccaaccaagcaatccagtccacctacatcaaccgcatcggcgcaggcttcctgttgcagacggcggtgactcgtcaggcggaacgtgtgaccgcgcaggaaatccgcatggtcgccgaggaactggaaggcgggctgggtggcggctacagccgcatcgctgcggacgtgcaggtgccagttgccttttgggtgatgaacctcacgggccgcgacatccgaggcaaggacttggagcctgtcatcatcaccggcttggccgcgctctcccgaacgggtgaccgtgaccggctgttggagttcggcagcaacctcgcaaacgtcctcgcgctgccgccgcagattctcgaacgactgaagctgtccgcgtggatcgccgacctcgccgccgctggtggcttggacccgaacgtatacgtgctgactgaggccgagtacggccagatgatgcagcagcgtgcgcagcagcagctggtcatgcagaacgcatcgcagcagatcgacaacgccaacaacatggagacacagacacaatgagttccaacgcacctccgggcggtggtcccggcgcaaccgtgatcgcaacctcgcacggcaaccagcccgccccggcagctccggctccggctgacgacaggctgctgcccaacggacagcccgcaccggctgcaccggcacagcccgcagctcctgctgcgcctccggctgctgacgctctgagtctcgaacccgctgctcccgcacagcccgccgccccggcgaacgctgcgccgactgctgtgtcgattcccgactacggcgacaacggcctgaacatcgcggccgaatacttcgtcaacaccgtcggcctcgacatcgacagccgcgaactgaccgaagcagcgcagggcaacttcgccctgctggaagccaagctggaagtcctcggcgataaggccaagggttccgcaccgatcctcgctctggcgaaggagagcatcgctcgtgtcaccgccgctgcaaccgcagcgcatgccgcgaacgttgctgctgtccacgaagccgtgggtggcgcagagaactgggctgcgatccagcagttcgcacgggccaacctgcccgccgaccaactgaagcaggcaagcgaatcgctgtcggctggtggcttcggcgctcaggcgaccgcgcgttacctgatggctctggcacaggccaatcccgcgacgaccgtcaagggcgcaccggctaccaatgccgccgctcctgccgcgtcgatcaacggcgtcgctcctctcacgaaggagcagtaccgcgctgagtaccgcaagctggttgccgagaagggcatccgtggtgcggcccactccgaagaactgcgtgcactcaacgcgcgcgtcatccactaagaaccaaggagcaacataaagcatgagcaccatcttcccgaccgtcccggttctgccgaatcaggtcaaccagtccggcaacgagaacgcgctgatcctcgaacagttcaccggcgatgtcgagcacacctacgtgtccagctcggtgctggaaaagttcttcccgcgcaagcaggtcaagggcaccaacaccctgaccaagaaggccatcggccgcaccaagcttcagaagctgaagcgcggtgatgcgccggacggcaccccggtggacttcagcaaggcgtcggtgaccgtcgataccatgctgctgtcgcgtcacagcatctggcagctggacgaaatcttcaccgacatcgacacccgcaaggaaatcgccatcgagcagggtcaggaaatcgccgagttcgtggacctgaccatcagcatcgccgccgccaaggccgctgctgccacgcagtcgatcttcacccgcaacggccgcgcgccggaaggccacttcggtgccacgcaggtagtcctgtccgctgccggtgacgagaacgatccggccaaggtctacgccgccatcggcaagctgttctcccgcatggaggaggagaagaaggtcaagccgcagcgcgacggcgtggtcctgatcgtgcgtccggcgatcttctacctgttgcagcaggccgagcagatcagcaacggcgagtacctgacctcggacggcaacaagctgaccggcatcccgaccttccacggctggggcgtcccggtgctgtcgagcgagaacctgccgaacaccgtgatcgaaggtcacctgctgtcgaacgacgacaacgacgacttctacgacggcgacttcagcaccctgatcgccgtggccgtgtcgccgaaggccctgctgatcgccgaagcgctgccgttgcagtcctcggtgtggtggagcgacgcctcgaagtgctacttcgtggactcgtggatgtccttcgccgttggtctggatcgcgtcgagaacgcgggccgcatcgacaaggttgcctaatccgctgggcgcggtccctgaatccttcgggtaactcaaaccgcgcccgccttccaccaacacaggagcaccatcatggtctttgaccgaccgttcgagatttccaaccgcgtcgtcgccgctaccggcgtggccggtctgcccgacaactccgtgggcaccgtcgtcggcgtccactacgacgccatcggcgcgggctgggtcgtgcgcgtccgtttcgttgacgacgaaatcggctcgcaggacgtggagtacgcaccggcctcgctggctctggctgcggactaagcaacatcccggcaggggcgctacggcgtctctgccttgttcctctcaggagacaccatggcattcatcaccaagctcgacatcgtgaacgcctgcatcaagacgatgggcgagacgaagctcaacactctggaagatgaccacgtatacaaggacgacgcagttgacttgatcgaccgcgtgcaccgcgacgtgtcgtcgctctcgctgtggttcaacaccgaatgggtggagctgaaaccgcaggcaacgagcaagtacatcatggtcccaacggacgtgctgaagctggactgcaacccgagccgattcggccacgtggtgcagcgcggacgccgcctgtacgaccgcaagcgcaacacctacgagttcgaccacaacgtgcaggccaagctggttcggctgctggacttcgatgacctcccctacgaggtgcagatgttcgtgcgggacgacagcgtgctgcgtttccagtccgacttcgacggcgacaacaccaagtacgccaagatcaagcagcagcgcgacgactcgtggatcaacatgaaggccgagcatatccggcagatcaaggcgaacccactgttcgcgcgtgcgtccgtggacgtgctgcatcagcggtacttcaactacagcggacacccgtggcatagccactacactttccccggctaaggaggcaacatggcaaaggcaggcggaacctatcccgacatccttcagggtgtcagtcagaaaccggcgcaccgtcgtcggccgggccagacgcacgagcagatcaacgtgctgtccgatccggtgaacggccttgtgcgccgtcgtggtacgcggttcgctgcttcccaagccgttgtcacctcggccgagctgcgcaacatggacgtgttcgacttcatgcaggaaggcaaggagtacgcgctgctgtatcggcgcgatccctctacctcgggaagcgagacgttcgcgttcctttacaacaagacggacgaggcgttcatcccgctggtctacgagaacagcacgtgggtcaacacgctggtcagcggcggcgcgtcgtcgctcgcggccatcggcagctacgtctacatcgcgggcaacaccacgatcccttcggccaccagcacgaacgtgtggcaggagcagacgaacatccagcgcctcgccgcgtgggttcgcaccggcaagtacaacacaacgtacacggtgaacctgacgcgcacggacaacacggtgctgacggttacgttcaagacggtgaccgcatcgtaccccggcacgctcgacacgagcgacatcccgttctacctgcccggtggcacggagccggacccggcgtatcagaagtacgtcaacgaccgagtgaacgagtacaactccgcagtcaacgagtggatcgtgaccagtgccgagcagacgcgcccggagtacatcgccgagcagctgtcggatttgctggtggacgcgggcgtggcggctacccacatcaagggcggcatcatcattgacgacgaccagttcaaggacatcacggttgacgacgagggcgacggcacgaccttctacgccgcagggcaggagattaccgacgcgacctacgctgtcaagttccactggcacggcaagatcatccgcgtgcgcccgagcggtgcaggcgcggacgagacgtactacctgcgtgccgagttggagaacggcgagacttcgggctacggctcggtggactggtacgaagcgcccggcgtggagtgcaccatcgacaacctcgtgtcgcagctctacatctacaacggtgtgggctacatcgcacgcaacggcgcgggcctcacgtctctggctccgggcagcggcgagcacccggcttacggtgcgcgggttgcaggcgacggactgacctctccgatcccgtggttcatcgacaagccgatcaccatgctgtccgtcttccaagaccggctggtggtgggcgcgcagaactacgtcaacgcctcgcggtcggcggactacctgaacttctggcgcggctctgccgtcaccatcgaagacagcgaccccatcgaaatcttcgcgcatggcagcgagggcgatgtgctccggcacgccacgctctacaacggcaacctcgtgatcttcggtgaccgtcagcagtacgggatcagcggcgactcggtgttcagtccgaagaacccgcttatcaaggcgttcagtgcgaacaaggattcggtggacgcgaaggcgcagacctcgggcaactacatcttctatgcgcagtacggcagcgaaggcacgagcctgcaccagatgcgcgtcggtgcgctcaacggtcagcagacggtgacggacgaaatgtccaacgagctggactcgtggctgtccggcacgccgttgcagatcaccgcgctcactgccccgaaccttgtgatgttccgcacccgagagcacccgcaggacttctacctgtaccggtacgaggacaacaagaacaacgggcagcgtatcgtggactcgtggtcgaagttccagtaccacccggcgctgggcgaaatcatcggcgtcagcagctacaagaagaacggcctcgtattcaccgcacgcgggtcgctggtggcgtgcgacgtgttcgacccgaagggcgagccggactcgcatgcgtgcctcgacagctgggcgagttttggtacacctacgggcgtactgaccgcgagcgcaagcatcgccgtcaatagcactagcccgtacttcctgctgggttgtccctacgctcaggcgtcggacttccttagccagttcgatgacctcgatgctggtgcgctggaatacggcgtcgtgtctgaggcgctggtgatcccgaccaatccgttccctcgggaccagaacggtcaggctgtgctcgatggccgcatgtcgctgaacaaggtgacggtggacgtggagaacacggcgggcatgctcgctgcggttaccacccgcaacaacagcgtgaccaccacggacttcgagggccgcatcctcggcgactccgacaacctgatcgcgcggcaaccggtgtaccgggggcagctgaacatcagcgtcgggcgcgaagtgcgtgagtgcacctacgagattcgcagcaaggattggctcccgctccgggtgaccggcctgagctggacgggtcagactttcaacaatgtacggagggttagctaatgggttcggttaatacgatcctgcaagcgaacaacaccacccgcgttgcccgtgcgaactaccgtgcagccgttgcgcagaccgacaacacgaaccgcagcgaggtcgccaagaccggcttcgctgatttcatgcggtccctgaagaacaacgcccagctggacgccgccgcgaaggagtacaactccaacatggaggcgctgtccgaggagctgcgtgcacgccaaggggctgggcttaactcccagctccaactggcgaacgcgcgcggtgcgcttcaggcacaggccggtgctgtaggtgtgggcggctcgtccgcagacctgatggataccatggttcgcttgcaggcggaaatggacaaggagacgcaggacaacgcagtctcgctgctcgcctctcgcggcgcatcgcagacggcgcaggtcatgtcgcgcgcgtggaatgggatggacatgagccgcacgttcggccagttcgactactcgcagcacatcgagccgaaggcgatgaagcgtcgcttgggcaagctgatcggcgtggccgtggctacctacttcggcgggccgatggcaggcgaggctgtggcagacttcgcagtcggcacgtggcaggcggacaacggcaacttccaaggcatgtcgcagtccttcaacaacgcagcgcagaacgggatgcaggcgtggcagcagtccaatgatcgcggcggcaagtcgtgggcgtccactaccttcgggtacaacgacggcaccggcaagcagtccgtgaccggggcgaaggtcaccggcaacttcggcaacaactacgacaacttctccaccactacgtccggcctcggctggttcgacagtggcagcggaggcaactcaggaggcgcatggtaatggctgacatcggcacggttaccttcaacacgcagtccgcattgcagggtggcatcaacgccacccccgcactgtcgggcaacaccagcattcaaggcgctggtgtgaatcaggtcggccccgttcgctcgggatcggattggttcgagagcactggtggtatgacgatgccggacagcaacctgcccgagttcttgcaggaactggcagcgccgaacaccgccaagctgaagcagcagcagatgtgggacggcttcgttgccgcccgcgctggtaagaccatggacgagattgctgcgaccgagccgtggtacaagaaaatcttcggcgacaccaactacgagattggcgcgagcatgtataacacgctctcgcaggtcaacgaaatggagagcgacctgctgcggcgtatgccggagttgcgtaagcttccgcccgaggcgatggcgaaggagttcaacgacctcgccactgcccggatgaccggcaacggtttcgcggacacggtgttgcagaagaccttcatggatcgcgcgggttcgctgatggacctgcacacgaaggagcgcacggcgtggcagcagcaggagctggtgaaggcgcagtacgctgcgaactcgtcggcgtccactggcttcaacgaactggcgaagcgcacggcgatgctcggtaccaaccgtcccatggacgagaaggccaccgaggcgctgacacaggcgcagctgtcgttgctcgacggtctgtcgccctcgcgttaccagacggacgagtcgtacaagtcggcgatcaccgcgttttaccgtggcgctgcggatcgcggcgagttccacacgctgaagttcctcaacagcaagggcgtgctgaacgccatcgaccccgacgggcagctgggaatccagcagtacgtgaagcaggcgcaggatcggtaccgctcggactggctcgatgccaacccggagcaggccgagaagatggcgcttgtctccatgtacgcatccgagggcattggtgccaagccgtcgcaggcgatgatcgaggaaatgaacgcgacctacgccgctgagacgggcagcgatgcgccgctctactcgggcacgcagcttgcttcgatcatggcgcagtccgcaggcgcgcacatccgcgcgcaggaagccgtcatcaaccagcgcaacgctgcggctaaggctgcactgactgaccagcagaagctggcggcgcaggaggaggacatccgtggcggcatcgagtcgttcaagcgcggcacctacgcgcagacgatcaacatccccggcgtggacaaggagctgatcgaagcgaacgtggtgcaggcgtggaactccacgatggccgcgaacccgaaggtcgccatgtcgcagctggtgtggaacgccaacacagggcgcggcgctgtgctgaagggtgtggccgatcagttccagaccacggcgcgcgctgtgctccgcgatcagccgaacacggcagcggctgcgctgtaccagcagtggaaggaactgaagcagacgaccgctgcgcgcatcgacacgaacggtcagcctgtgcagggccgactgactggcgcaactaccgccgcgctgtacttcggagatagcgtcaacacgttcttcaacaagctgcaagcgttggagaatggcggcgtgaacttcgagcttgcctacgaggtggcccgtggagaaatcaccaccgacgatcccacgcagttcgacgcgaacagtcgtaaggaatccgaggctactcaggctcgtgttaacgacgctatcgcaaagctcaaccccaagtacctcggtatgttcggcaacaagctgggcgactctggccgcgctgcgtatgctcgcgccatcgtccggtcggtcaccgacagcggtgggctgctggacacttctgcggaaggcttgcaagctgcggctacccacgctaagctggcctacggtctggaagacgcgggcaagtacgcatgggagaacggacgcgacgacgaaggccgagtgatcggcggtgttggtgcgtggctggggttcatggacacgaaggagacgggaccggccatcgagaaggccatcgacgcagcactgcggcgggtcaacatcgagcctactaccagtctgaaggctgacgtgttccgcatgaaggacagcgagaacggcgagccggtgctgtacgtcaacgctgttggcgagaagggctggaaggttgtgccggtgtacgggcgcgacatcaaggccgagtacgagaagcacacgaagcagcagcggcagttgcaggccccggtaccgcagggctacgttcgcatgaacgacggtacgattcagcagagcatttccatccaacccaaactgtaaggagatagacaatggcactcgatctttcggggctgacccaagaccagcagattgccaaggctgccgcttatgcgggagtgccggagtccatcgtgcgcggtcagtggcgagtagagtccggcaacggacgcgcagccaaggacgctgacggtgtgatccgcagcaaggcaggagcgcagggcgacttccaagtcatgcccaccacgcaggcaacgtgggaagcgcgcaacggtcgcaagtacgacatgcgcaacttccaagacagcatcgagctgtacgccgacatcatgcgcgagaacatgcagcttgccaagggcgacgttaccaaggcgctgcgcatctaccaaggcggcaccaacccgaagaactggggacaggagaacgcagcctatgcaccgagcgtgctgggtggcgcatccgctcccgccgtgtcggcgcagccgcgcagcctgaccaccactcaggcagacctcaacgccgcgtggcagggcaacccgaacatgcgcgaccgcacgtggtccggcgcttccatcccggatgcgtggaccggtgctcccatcgaaggccgcaacgctctggcgtcggcagcgaaggaacacatcggcaagattcgtgcgggcatcgccgagctgtcgatgggtcaggtggcgcaggaaggtggcaccgcagagcaggctgtgggcaaggcgcaggccgtccgtgcgtcggatcaggtcgtgccgtggtgggtgcgtcaggaagtggacgtgctgaataccggcgctcgcaaggcgctgctggatcagaccgagcaggctctcgcacaggagcgtgcagacgaggagctgcgcaactcgctgaccttcctcgacaagtggggcgcggcattcgacagcggcatcggtgcggctatcagcaaccagcttgcgcgcgaggacgagaacatcccggaaggttggaagtacgacccgaaggaatgggagaagtcgtggatgaccgccgacgaactggaagacatccgtgacgctgcgtactcgccgaacgagctgaagtacgtgagcgaccgccagtggatgcgccgcaactccatgcgcatcaaggatcagcagaccggctggtcgagcttcggctacgacctcgtggcaggcttcaccgatccgggcaactgggctatcggcggcgtcaccgctgcgggcgctaaggtgctgggcgtgggttcggctgcgctggtggccgaggggcgtgtgggtgcttcgctcgcatctgccgctgcggagaacgcggtaggctccgtcatcacggacgccgctctggtgggcatgggcgagcgccgcaacttcgcggactttatgaccgacgctgcgttcgctaccaccatcggtaccgcaatgcacattccgggcgttcgctcggctgcgcagattcgggacaaggctaccatcgacctgtccgcaggcaacgctgccgcttacggcgaagcgtggtcggctgacctgaaggcgcgcgcggtggccgagcttggtgacaacgccaacccggtgctggtcaacaaccgcatccaccagcttgccaagcaggaagcagtcgattggctgcgcgctggtatggctgatgtgccggacgacttccgcatcttcgcgcgtcccgacgtgcaggagacgaccaccaccgcaggcaccactggtgcactggctcgtgacgtggacaacgtggacgcctcgaccggccggtacaacgacagcgtgggtggtcgggtagatcagcatgatccgctgctggaacgtgcgtggaaggccgcaggcatccgtggcggcaacgtggacggcgtgctgaagtatctggaatccaacgcctcgatcccagaggacgtgcgtgctatcgccaatgcgctgaagcgcggcggtcgcctgagcacggtgaagatcgtgccggagtcggaactcgacaagtggttcgccggtgccaacatgggtccgggtatgcgagtggccggtggctacaacgccgggctggacgcgatggcgatgcggaactacacgccggaagtggtggtgcacgaaatgctgcatgctgccaccctgcgtgagctgcgcagcaactcggtgttcggtcaggaaatggaagaactgctgacccacatcaacaacagcatcggcagtgtagactccacgctcaccaccgctgcaatggagacgcgcatcaaccagccgcaggcaggcttcctcgccaacaccgacgagctgatttcctacggcctgacgaaccgcgccgtgcaggcggtgctgcgtcagatgcctgcgccgggcaacacccgcccgaatgcgtgggagtggctgaaggacaagatcgcgcgagtgatgggcctgaagaatcaggagtccgctctcgaacgtctgatgtctgtggtcggcgacaacctcggtgctgaagtgcgcgacacgcaggcatcgacccgacagactcgtggcatgctcgccaactcgatcttcaagtcgaaccgcgagcgcaaggcgttctatcagcgcactggtctggacaagtccgtcagcgacgacgcgatgcgcgtgcaggttgccgaggtgatggcgcgctctgagcgcttcagtgccaagtacggcatcgacgcggcgaagctgtccaccatcatgcagcgcttcgggctggaagctacgagcacgaccctgatgtcgtccaagtcgccggtcgctcgtatgcttgctgtcaccctgttggagaacccggagggtgcggcaggccgacacagcacggcggcgatggatcggcatggccggttcgagtcgttcatgggtacgcgcccgcgtcagtgggaagcggcctaccgtctgtggcgcgcggacgttcgcggcatcggtgcgatcaaggacttcgccacgggctggaaggcacgtgcggacttcgagtacgcagtgaagctgtaccgcgagactcgcttcaacggtggggacatcccggatgcgcacgaggcagtgaaggcaatggcccgtgagctggaccgtggctacaaccgcatggcagcagagcagcgcgcggctggtacggtgggcgcacagcgtctgccggaggaagacgtggagggctacgagtcccgcacttggctgggtggcagcatcgctgctgctggtccggttcgccgtgagggtatccgtcaggcaatgcgcgatcagttcgaggtgatgggcgagctgtatggggacgacttcctcgacaagttcgctaccaagtatctggaacgcatcgagcgcaaggcggcgggtatcatcgaagcgccgggtcaggtcttctcggagtcgcaggcggacacgctgcgcgatactctgcgggcgatgtcgctcaacgaggaggagattcagaaggtgatgggcaagtacagccgtggcggtgcgaagcacaccaaggcgcgtatcgacctcgacgtgaccaagcagtacgaagatgctgatggcaagttccgcctgatggactacctcgacaatcgcgtgatggacaactaccgcaagtacgcgggccgtgttgctggtgacatcgctctggcgaagcacggcatcctcggtgatgcaggcatcaacgtggctcgcgaagcaatgcgcctgaccggtgcgactgacgtggagctgaaggcgttcgagcaggtgatgtccgagttccttggtcgcccggtgggcactggtgatccgactgttctggcgaatgcgcggctgctgacctcggctatccagctgggcggcgcgggcatcaatcaggcagcggagtacagcaacggcctcgccgctgttggtgctgctggtgtggctgacgcaatccgtatcgctcctcgcatgcgcagcgaaatcatgcgcatcctgaagggcgaggacagcggcaaccaaatcctcgacggcttcgagttcatcagcggtcgcggcttcggcctcgccggttacgatctgcacatgttcaactcgctggacacgcaggcgtcgatgtacggcagcgagcgcgcaggcttcctgacctcgctggtgcagaaggcagcgcatgcaaaccgcatcctctcggggcagcgggctgtgctcgccgtacagcagcgcggcttcgcggaagtgctgatcgccaagggcgtgaagttcctgcgtgatggtgccgaggccgacaccgccctgaaggacatgggcattgacgacaacctgctgaaccgcctgcgggcgacgcaggatcgggtcgtgcgctggggcgctgacggtaagctggaagcggtggacccgcgcaacgtcgaaggactggcggatcggcaggcatggttggcgttctacaacgcgatcaaccgtggcacctcgcagattcttcaggacaccttcatcggcgagactggcaagtgggcgcacaacggctggctgaagctgctgttccagcaccgcaccttctcgctggtcgcacagcagaagcagctgggccgctacgtgggcaactacggtgcgtggcagacggcgggcctgatcgctgcggcgatggctgtggctgcgccgctgcaagccctgcgcgtgctgtcccgcgtggccctgatgaacgatcaggagcgcgacgaagccatcgaccagaacatcctgtcgcctctggcgctgggcaaggccacgctgaactacgtgtcggcgacgggcatgctcaacgatgtgctggacgtgggcaccggtgtggctggtggctggtacgagtacgccaccgatacgcagggtccgacgtggctgaagcagctggccggtgggcagttcggcaaccgcaaggaagtggtgggcgggcagttcgcgcccgcgctgggcgtcgtcaatgacttcgctcaaggcatcgctggcaagccggagaatctggccgacgtgattccgggcgggcgactgcccatggtgatcccgctgttgaagggcgcggccagccagtggaaggaggagtgagaatcagggccaaggacggcccacccttttggtacacctatagcaaacaggaggcagcatggcagttccagacccgcagctgcgctacgcgacagacgtgttcgacgccgatggcgtgaccactgactggcagatcagctttaccggtggctacatcaacccgtcccacgtgtacgcaatgagcggactgttggacgaggagactcagctgctgaccgaccggactccgcacaccgtggaagtcctgagcgaagacgatgacgctagcaccgtccgtgtctcgcctgccgtcgccgctgggcgcaagctctacatctaccgcagcactccggtgcagcagatgctcgttgactacgttaacggtagcatcatcagcaagaccaaccttaacctcagcaacgaccagctcctgaagatcattcaggaaatgttcgactcgctcaacatcgccacccttagcatcgaccaacaggtcggcgtgatcgtggacctgaacgagattatccagaacatctataagcaggtcaccgagttgctggccgctggtggtatcgtgtccgtcgccccgcgcgtctggtccggtgcatggaccggcgatcaggtggacgacaccgacttcgacatggtgggcgcggacgtgtccggcgctggcttctacgacgtgtacgtcaacggaatcggcatgcagccggacgtggactatcaggtcactctggccgacgacaccgatcccagcttcatccgcttcgccacggttcccgccgagggcagcatctggttcgccgtgctgcgtggttacgccaagccctacaccgggcctgcgccgatcactgctacgagcctgcgggtgccgatcatcccggcagaaggtccgacctactacgccgacaaggctaccgagtacggcctcgtgcggtgcacgtatgccggaggctgtgccgtcaacatcaacctgatccccgaagtgggcgacggtgagacgaagcttgcctcgggcagttacttcagcgttcagcagaaggcaggcccggtggtcatcactggcgacgtgggcgtgaccctcgaagtcccggtcggctgcaccgccgcaactcgcggcaccaactccgtcgtcactgcaacgtgcatcgacggcgacaccaacacgtggttgctctcgggcgacttggctaaggagtaagcatggctaatcacttcaggctgtacggccgaccgctgatggcggacgaggttgcagatggcctgtcggtgacgggcgtgctggaagggtacacggcgggcgaggcttacgagtctcgcctgtccatcaacaacccagtcggccgctgcaccgtggaggtcatcgaatcgacgctcccttcgggcgctgcggtacgggtggacaacatcaccaaggaagtcgtcgtcaagtgggcggctttcactgaagtcgtggacgaggaaaccctcgtacccaacggcgacttcgaggcaggcgacgatggcacgtgggtgccgggcggcggatcgaacggcgaaggctggtcgattggcactggctcggactacgataccgacagcggcgtatacagcgcgcgcttcgccaacatcaagacgggcggtagcgacttgctcaacccgctgatccccgccaaggtcaacgactacatccgctgcaccgctgaagttcagcagggcgcaagctccaagggcaaggccggtgcgcgcgtctcgatcatctaccgcaaggaggatggcaccgagctgcaacgcaactggggcaacatggtttcctccggcagcaacggtgcatggcaccagtctgtcgccgagggcgcagcgcccaaggacacgaagtacgtgcaggtggtcctgtccgcattccgcagcaagcagaacaagccgctgtgggtggacaccgttaagtggaaccacaagtacgtgctgggtcagaacgacgacagctcctacttcctgagcatcaaggtcacggacgggttgaaccgtgtggcctactggtccgggcgtatcgaggagcaaggcatctacgtcacgtcgaagctctacagcttctaccagttcgatgcagctatgctgaccagcagcttcgctggatacagcaacatcgacatgcttccgcctgttgactctgcgacgttcggttcctccttcgtgagttgggaaatccgcagctcgcgtcaggattacaccgccgagccagagacctcactgtacggaagctcgttcgtgtcgttcgacatccgctctatccgaaaggactactcgcctgacccggagacggcaaggctgtccagttctttccattccttcaccctgaagcagcaccctgttgtgaaccagccgcttgatgcgtctgcccagctgcggtctggcttcgtatcatggagcttcgcatgatccacaatcgactcggcgtagccggtgtgttcactatcagcaagggaaagtccctcgattcgctggaagttgtggcagactggcagaacaacctcatcactgacggcggcatggacgctatgggtgacaacggaaatggctacgcgcgcagcatgtacgacgttatcgcgtacttggcagtcgggagcggtagcgcgacacccgcgttcactgacaccgctctcggtgctcaggtggcgcaggtcgggcgcaccacgtcggacaacggcgggactactactgccccgtactacgcctactcgcgctgccagtaccagttcccggcaggcactgctaccggcgtcctttccgagctgggtgccaaggcgtacaacagcagcaacggcacctacatcctgaccacccgcgcactcatcaaggactccgcaggtaacccgaccaccatcacggtgctgtcggatgaaatcctcgtggttacttacgagctgcgtctctacatcgacacgactccggtggtgacgactgagacgatcaagggcgtcagcaccactgtgacttgcaagcccatcgccctcggccggagtggttcgctcagtgggcagtctgccatcgcgtggtcggactacgtgtggggctgctactatttctatggcggaaccggagacggtaccggcgcgatcactgaccagtatcctccgggaaccaacatcagctactcggacttgcagattcagtatgtggcctacgttgctggtagtcactatcgagacgtggtgtgtcgcatgtcgatcaacaacgttcccggtggtccgatcacggctgctatgggcctttctgcttgcgcctcgttccaagttggcttcagtccgggcatcaccaagaccggctcggagacggcgaacctgcgcatgcgcgtttcgtggagccggtacacgccatgatccccactgtctcccaaagcatccaacggggtgactgggtggagcagcagaatcggcgcacccgcccgctcatcgacttcgagcagggcgggctggccctcaacgcatccgtggacgaccttcaggctgcgttgtggaccgccgagagtgatggtagcagcgtcgtcgtttaccgcgacggcgttgctcctgtcaccgtgctgacggactcgggtatcacgcagatcgcactggcattcgaccagaccatgcgcccgcacatcgcgtacatggcaggcggcgtgtgcaagttctactggtacgatacggtggctgcttcgatgcagaccatggtgatccccggtgctaccactccacgactgtgcatggacgagaagcgagcaatcttcgccactcagagcgacgtgctgctgtcctacaagaatgggagtagcctgtgcgttcgagcacagcgcgagcgcttcgcaaccgaacacgtgattgccaccggaatccccggtgacctgatcgcgtttggcatgaacaacgtcaaccgcctgcaatggaagctcgtcggcaatcccgacgactggccctaacctacaggagaacagcatgaccccgccgagtgtggtcaatgaggtcgtccgaacctcgccgcttacgctcggcgcggtctacctcaacttcatcagcacttacggtgctgccatcgtaactacgctcgccattctgtacgcagtcgcccagttctactggcgcgcgcgcgagcaccgaaagatcatgggagggaaggatgtcgaaccccgcaagtgagggcgcgcttggcgcactccacgaacttgtcgccacggtactgaaggaacgcctcgccaacggcgagctgtgcaccgcagcagacatcaatgccgcgatcaagttcctgaaggacaacaacatcacggcgacgcgtgaggccaacaaggcgctcggcgaactggaagacgaactcgggaagcactcgctgccgcaggccgacgacaccgagctgcaagcagcgctcgacaacatcgtgaactttccggggagcgtagccaaccatgcgtgaatcagccgaagcggcagacattcgtcgccgcaagttggagctgttgcagaaccactaccgccacttcgccaccttcatgcgcgacattatgaaggtgctggggttcgagccgacgtggatgcagtacgacatcgccaactacatgcagtacggcccgcacctcgcaatggtgcaggcgcagcgaggcgaggcgaagtccaccatcgccgcgatctacgccgtcttctgcttgatccacgatcccacccaccgtgtgctgatcgtatcggcaggcggcacgcaggcatccgagattgctacgctgatccagcgcatcatcctcacggtgccgacgttggagtgcatccgcccggacaagaacgcgggcgaccgcaccagcgtggacgcattcgacgtgcaccactcgctgaagggcatcgacaagtccccgagcgtggcgtgcatcggcgtcaccggcaacctgccgggtaagcgcgcggacctcctgatcgccgacgacgtggagtccaacaagaacagtcgcactgccgcgaaccgcgagctgctgctgaccatcacgttggagttctccgcgatctgcaccggcaagcccggcacgccgggccgcatcctgtacctcggcacgccgcagaccggcgactccatctacaacaccctgcccggacgtggctacgacgttcgcatctggcccggtcgctacccgaccccggcacagcgcgagcactacggcccgcatctggcaccgtccatcgtgcagcggctcgaagccgacccgatgttggcgttcggtggtggtccgatgggcgacgagggtcagtgcaccgacgagctgttggccggtgagcagaagcaccagtccgaactgcgtcagcgtggaccgtccagctaccagctgaactacatgctcaacacgcggctgatggacgcgctccgcttcccgctgaagacggagaacctgatcgtgattccgggtggcggcgaccgcttcccgctgacgatcactcgtggcctgagcaatgcgcaccagcgcagcttccagtccagcggctacggcttcgtgatgatgatgccgcacgacatgagcaccgagactgccccagtgcagggcgtgcacatgcagatcgacccggccggtggtggtgccaacggagacgagacggcgttcgccgtgaccgccttcctcaactccaccgtgtacgtgttggccgtgggcgctgttcccggtggctacgacggtgacggcctgctcgaactccgccgcatcgcggtgaagtacaagccgaacgtcatcagcatcgaaaagaacatgggctacggcgcgttcgccaaggtgttcctgcctgtgctgcgagaagatcgcggtaccgagaagggatacaagggcgacatccgcgaggagttcgtgaccggcaacaaggaagcccgcatcatcggcacgctcgaacctgtcatggctcgcggctcgctggtcatgctggaatccgtggttgaaatggatcacgagtacactcagcgctacgcatccagcggaaagcgtcaggtctacagcctgttccaccagatggcgaagatcacgcagcagaagggcagcatcgcacacgatgaccgcctcgatgcactggaaggaagcgtgcgccactgggttgcgcagcttgcactggaccagaacaaggccattgccaagcagcagcagcgagagttccaagactggatcaacgatccgaccggcatgaaggcagcgacccgcaagagtccgctgcaacgtggccgtccatccctactcgaccgttaccggaggtaaccaatgcagaagtccgacttcaccagcaactacacgggcctgttcggccgtggcaactacctgcaccgcgaactgctcgccctcgtggagcatgcggagcagcatcccgcaaccgcagcgcagctgctcgcccagttccagaaggacgcgaccctcgtgctcgacgccctgattgctgccggtgcgcgcacgcagtcctcgggtccgaactccggcccgcacactccggtcgatctggacccggacgatgacccgctgaccccgtaaggagcaaccatgaaccagcagcagaaccaagataccagcaacaaggggctgttcggcctgatcggcggcatcttcatcggcatttcggcaacgctgctgtcattcacccaaggccacgaaggggtacgctacgctgcgtacctcgacaccggccgggtgccgaccatctgctacggccacaccaagggcgtagcgatgggcatgacggcaacgaaggcacagtgcgacaagtggctgatcgaagacctacagatcgcccagaagggcgtgcgtaagcacctgaaggttcccgttaaccgcaaccagatcgacgcctacacggacttcgtgttcaacgtgggcgagaaggcgttcgctgatagcaccatgctgcgcaaggcgaacgcaggggatcgtgaaggtagctgcaaggagttcctgcgctgggtctacgtcggtaagctcgactgccgactgtccagcagccgctgctccggcattcccaagcgccgcgacgcagagtttgccctctgcctgcgccccaacaacgaggtgatccaaccgtggaaaccccaagtgaagtgatcgcacgcctcggcggcaaggctatcggcctgctgctggtcgtgaccatgttcgtgtgcttcggtctgtacgtctacggcctgcaacgcaaggtggagaagctggaaactgcccaagtcggcacgaccgctaccgccaaggctgcgcagactcaggctaccgggtacgcaacctacatcaaagagaaggagg

SEQ ID NO: 20 - DNA, 44521 bp, Unknown
  Bacteriophage Xfas302
cggcaagtggtaagccaccggaacagcggaacggttagcaccttgcggactaccggcatacatggtaggatggtggcgacaggacgcccaacgggttagagactcgaatcgagccaaggggcttgacaggaagcaaacagggtgctagtatggcaccacgctctgaggagcaccggcactggaccgggcaggactaccgctaacgggtagggtgtaacgggaagccttataggtggaccgccaagctgcaacgtagcactagcggataaccggatgaactgggatataaaaggcccatagaatccaccagactagcaacactggtgccgctttacctaagcctaacgcttagggcttcccatctgccgtgagagtcggccacgggaagtaacccactgccaaggtgggaagccggtcataagcgggtggtgagcctgctatggtagggcataccctatctttcgtgaaagcttcgggatcggccacggtgacaatggcactgctagccggagtagggttgacagcccgaagggctagcagattgatgcacactcacgttacagctaacttcccacctgacgccgcaaggtattggattgccgagggagacgactagggttgcgggtagtccctgattagctgcatcgttcgcttctatcacggcacacattcgagtgtgatagctctttgtggagtgtgcatcaatctgttagttttcccaccagtgccaatggaggcacaccatgcaaggctcgaccaatgccaatctggaacgcacccgcaccaagcgccgcttttgccaattcacccggactgcaagcgtgatggacctgcggactaccgagcatgaccgcaagctcgccgagcgtaagcgccaagccgaacgatacgaagcccgccacggaaccgctggaaagcgatctgtgtttgctgtcgagggcaacagcgggaccaatcgggcgaaccacgccgctgatcggagggcctacctgtgatccgtttctacttcgccgcagggtacagcaaggccgcgtgggaaagccaccagcgcgcattggtcgctcactcggcgacacccgccgccgtctccgacctgcgatggaccggcgcacgctggacctacgacatcaccctcgccgcacctgcgatccactgaatgcaagctactgggccttcgcaagagggcctagtgtcgtgcaatcggcacggacccaacctaaagggaaccaccatggacatcatcaccggaagcgctgacatcaagcgcgccatcaagtcgatcaataccgctcgcaccaagctggtcgatcagattcagcaggccgccatcgcggtcatcaaccacgcacacatccacggcgacgttacgctcgcttccgatctgtgtctcgccgtgggcaacggcatgaagcatgaagccctgcgcctgtacctgtccgagttcggcccgatggctccgaacgacgacaaggaaaccaaggcgagcgcgcccatgaagttcgccaagagcaagcgcgtcgagggcgaagctctggccgacgtgctggaacgtgccgccgcgaaggcgtggttcgacttcaagaccgagaagcccgccgaggcgttctcgttcgccgccgacctgcacaagctgctgggccgtctggaaaaggcaaccgaggagggctacgtgccgaccgaggaggagcaggccgtcatcaacgctgcccgcgccgtcccgaagcctgccaagaaggtgaaggcgtaatgcggcccggcacccgcgtcatcggagccggtgtgcgtgggtgccgctgtctgaccgagggcaaggaatacacggtcgaggactaccagcccgcctataccgacccgacaagcgcgagcggtttcacgtggcctgcctacgtgggagtcatcaacgacgatggccgactcgcctactaccacacccaccgattcaaggagaaagccgatggaacccaagatcaacctgcgcgtaacccagcgtgaggcgtcgttgctacgctcggccctgcacattgcctgtgcgctgactgccaaggccgacccgtattccaaccgcaagctgtccaacgagttcgccgtgctgcatggtgagctgcgcgacttcggtgtcgagagcttcgagcgtgataccatcctgaagttcgaggacgacgtgattgcagcctgccgggacagcgatgtcgaggcgcagctgctgcgcgacctgttcgctcgccctctgactgtcggctacggcatgcgtgagatggactacgccgctatcgaggcccgcgtgatggcctgcctgctcgatccgatcccgccgctggtgatcgacgcatcgcagctgccgttcgagttcgtgggcaccgtgaccggccgcagcgtgatgtccggcccgtccatgccggacaacctgccgcgcaagctgcccgacgtgctgatggacgaccagagcgcacgacacgtggcgctgaccgcatcacagaccgggctggtgaacaaggccgagccgaagggctggatcgtgcagttcaatctgcgccatggcagcatcgccctcgccaactgggcgcaggtgcgtgagctgggtctgccgcagcgcagccgcaatgcagcgtaccgtgcactgaaggcgcgggccaaggcgcagggcatcgccgaggacgcctaccgtgtggtgcctgccggtactcccgatggcccggagaaggatcgcggcttctacaccgccgagttcttcaccaagcatgccctgcgtccgcatcagcttggctggaatacgtccggcgcacgtggtctgacaggcactttcccgactgcgcaggccgcagccaacgccatcgaccagcacgtaaaggacaccggcgcatcccgcagccgctatcgtgtgaagtggcacaagaaccgcgcgtgatctaccgctgcgccttctaacgagggcgtagctttggaaccacgcccaacaggagggcacattgcatgatccccgtaacttacaagcgcatccgtagtgggaagcgcaagccgatccagctgtgcgagaagccgcgccagtggaaggagttcgtgacccatgagcacagcgtggagcgctggtatgcgtgaggtcagcctgcgcctagtggtgaaggcgctgcctctcgttaccgtgaagggtgtagctgtcggggattacatcctcggcggccaccacaccagccacgaagcgtgcgagcaagccatcgcacaccaccgcaagcaccacgagaaggtgcccaccctctacaccgtagaggaaatcgaaatcccacccgtcaatgaggagaaccaccatgcgtaagctgtacttcatcgcttcgatcccggccaccgcgaaggatggcgtcatcactggcgtcgtcgccaatggcactggccgcaatgccaacgccgaggaagtgaccgcgctgatcgacctgctccgcaccaagggcgcaactccgtccctgctggacagcctgcgcgatgccacctatcccggtccggtgtctgccttcgagcgccgtgctgctgcccgtgccgaggccgacatcctgaactccttcaatggtggtggcctgttcaactggcacgtcatcgaagtgggcgacagcatccgcaagccggtgcgcaagccgctgggttggcgcatcatgtacgacacggactacaccagctgctacaacagcatcgaagacggcgcgaccgtgcgcatcgacggcgacgaggggaaccgtagcgaagacaacctgctgttcccgacccgtagtgcggcgcgcgatacgctggacaccatcaacgacaagcgcagcaagcagaacccgcagggctacttcatcgtcccggtgtacgccgatgcgtaagctcggcctgcgactgctgatcctgctgtactgggtgatcggtcgtggcccttgggttgtcgtgggccagtaccacgacgacgagggcaggatgtgccggttccgtaccggcaacgtctccaacgacggttactgggcgcgcacgttcgatgacctcgacgaggccaacgactactgcgacacccgcaacgagcaggcacacaccgatccgctcggcaccacgtactacgtgtggcacgagttggagttcaataacttcggaacgaggaggaagtaaaccatgggcttcatggacaagatcaaggcagctgccaagtacgtcaaggacaaggtggtcgcagcggtgaagccgcgtcacgacgatgacgatacgccgccgcccgccccggacacgagccggtacctgcacgtcagcaccccactgattcccatcgacaacccggtgctgcgcaagatgctggggcaggactacttccccgtgcagaaggggcagggtcagacccgcatcgtcggcaacaaccagctgaagcgcgtggccgatagcctcggcggcaacaacaaggaacgccgcaagctgcgctcccgcatgaagcgccgtgctgccgagctgcgtgccggtgcatcgttgcagccgaacgtgcaggccgcactggcaggtgccgcatgagcctgcgcatgggaagctgggtcgaggtgaccgtgcccgatagccgactgctcaacgtgcagccggagattgccgccgccgtgaagcttatcggcggtgcgaccatgaccaatggccgtggcctgtacgtccgcaaggacaccggcgcactggatgacgaggcggtgaccgtgatccgcttcgacctgaacttgcagagcgagctggtggaccagtacatgagcgcgatccgcgcaatcgtggaccgcctgctggtgctcggcgaggagagcgtgctgcgccgtcgcttctacagcatgggcggcgggtacaacagcgagctgatcttccagtaagaggaggcgcgatgcgtatcagggacggcccgacgtaacgcccaccaattattgaggatcgttgggagcgcccgcctcccttgattaacgggcaccatcactacatcaaccgtcaagaggaaccatctacatgtcgaacgaaaacaccaccgagcagaccaccatcagccactacgaagccaagcgcgccgagctgctggaagacatcgccaaggcgcaggccaaggtcgatggcctgaacgagaagctcgccaagctggatgccgtcgaagccaacagcgccgccatcgaagcgctgtccgctggtgacgccgtgtcctacgtcttcggccgtgctctgaacaagcgtgtgctgtcgggcgtcgtggtcgccaccggcaagaacgacaagggcgtgctgcaactgaaggtgcagaccggcgaaggtctggatgccgagctgaacctgatcgacagcagcgccctgctgatgtcggccgaggaagtgctgaaggcgcaggaagaaatcgacaaggccatcgccgaagcgcaggctgctgccgctgccaaggcgcagggcgaaggcggtcagtcgtgagccggggcagcaccagcccggcggtgccgccgaccagcgcgccgagccgcagccagttcaccgcaggccgtgacctgaaggtcggcttcaactaccgggccatcagctccggtgctggtgaagtgatcgacggcgacacctacctgctggtcaccaacgtgaccgacaagaagggcaatcgtcagctggtcaacaccagcaccggcgaggtgtccttcgccacgcccggctccatctggagctactgatccgacgaggatagcatgagcgatacccttcccgacaacgactggctaccacacgccgagcgcctgcctgttggtggccgcacccgagtggcccatgagtgcggggagggtacgcccttgctgattactcgtgagcatgacaagtccaccgcattctgtttcaggtgcggtggcacaggattcaagcgtgagcacgagagtatcgaggccaagcttgcgagaatccacgccgagcaaacgagcgagcgcagagtgcgcgcaactgttgagttgccagagccacgggtatacgacacccgcgagtggccgctcgacgctaaggtgtggttcttcaagatgggactctcgcttcagatgatcgagaagctgcggctgtactggtgcccaagcatcgggcgggtggtactaccgatcactgaaggcgacaacgtggtatactggacagcccggtcggcaacgagacagccgaagtggctaacacctgacgttccgaaagacggacttgtcgcacgctacggcgtgggcacaggtgacaccatcgtactgtgcgaagacccgctcagcgcatacaaggtgggactggtaaccgaagcgtggtcgttgctcggcacgaagctgcacaacaaagtgttgaagcagctgactgatcgaggccaacgtgtagcgacgtggctcgatgacgacagaggtagaagcaacggtagcaatcccggccaagacagcgcgcgagtaatcgctgcgcgtctacgtgcgtttggtctggactacaggaacatcacgtcaccacgtgacccgaagtattacacgaccgactacatcaaggagaagctgcaatgagcaaacccatcgtgcgctaccggcgcgctatcatcccgcctgtcgttggcttccgtgccacgctcggcggcgtgcttgcgcatccgaacctcggcgactgcgacatcgtgcacacctcgacggtgctgtacgtgacagacggcgggcgcaagttcgagacacgcaacacccggtatcaccagctcgattcaaagtacgaacccgaaggagaacctgatgagtcttgacaccacgctgctgcggttgtgcaccaaccgtggcaagttcgaccggctggtacccagcgcaccacgtgatgggctggacgagctgaccgtgctgatgctcgatgcgttgcgtgcgtactacaaggagttcccggacacgaaggacttgccgttcgatgtgttcgatggctgggccatggagttcaagtggaagacgcagcccgacgacaagaagtccctgctgaaagttctgctgaagcagatgcgcgagccggtcccgcccgaggcagagcagggcatgatcgagaagctgttggagttggagcttgccaccactgcggtcagcaagatcgtgcagtggaatggtggcgctgagttcagcctgcgcgacgagcttgccgggttggctgagacgatcaccgaccgcatggatcgcaaggcccgcctgccgctggtgcaggagacgcccgaggaactgatgcagatggacgagcacgacatcggcatccacttccgactgcccacgttggcccgcaacctgcgcgccctgcgtggtggtgacttcggcatctacgccatgcgtcccgacgcaggcaagaccacgttcctgaccagcgagtccagccactggatcacgcagctcgacaacgtgtggcccgaccagaagcgcaccggtatctggctcaacaacgaaggtccgggcaagcgcatcaagcagcggtggtatcagtcgttgctcggtgctaccatccccgagatggtggagtgggcgaaggactggagcatccgcaagcggatcgaggatgcaatgggtggtgacctccaccgcatgcagttctacgacatccacggattcaactccggcgaagtcgaagccatcatcaagcagaccaaccccggcttcatcatcttcgacatgatcgacaacatcacgttcaccggaggcatgaccaacggcggacagcgtaccgatcagatgctcgaagcgatgtaccaagccgcccgtaactggtgcgtcaagtacgacgcagtgggcgtggcgacatcgcagatcagcgccgagggtgagggcatccagtacccgccgcagtccgcactgaaggacagcaagacgggtaagcagggtgcgtgcgacttcatcatcatgggcggcaagctcaacgacccggcgatggaacgcttccgctacatcggcacaccgaagaacaagctgcaccgcgcaggcggtaagcgtgacgttcgtgaggaggtgatgatggatgccgagcgcgcccgcttctatcaggaggcagcatgagtcagacgaaagtggaagtgcacgggcaccgtgtgttcttgcccggcatccagaaaggattcgacacggtgtccagcagtcaggccaactacctcgcgtccgtcgtgagggatgcggtcaacgctgcatacatcgaaggacgcaacgatgctccgcagtggaagtggggatggttgcgcaacaagcacagcacatggatcggcgtgcactactcgccgcacaacaagcgctggtgcatcaacctgatcccatgcttcacgctgtggatcaccaagcccggaggtaacacaccgtgagtaccgaaccgaacatctacctgccgcgcaacgtgggcgtaatcacgtccagccgcaccggcagcagctacaccgtcgagcctgccgtgaccgacacggacatcgacttcctcgtgctggttcaggatttccacgaggccatcgccaagctggtcgagcagggctggaccttgtgctctggtgctgacgggcactacgaggaagacgaggactacagcgacacgtggtacgctctgcgcaacggcgtgttcaatgtcatggtgactgccgacagtggctggtataagcgcgcggtcgaggccaccaccatctgcaagcgccgcaacatcaaggacaaacaggaccgcatcatcgtgttccggtgggtgcgcgatgggctggacttggatggcgatgcgtcggatgaaatgtaccagcttgccctgcaacggtggccgctgtgagcttcacttccttcgacctcgaaaccacgatccgttccatcctgaagcgcaaggccaatccgttctacgacatgaacaagatcgtggcgattggctacaagcgcaagggtgacgcacggaacaccggcctgtactacgacacccgcatcggcatcgacaaccagtacatgggcggcgcacctgacgggtggctgcgcgagctgtgttacgggcagcagttcctcgtcgggttcaacatcaagttcgacatcctgcacgccatctgccaaggcccgctcaatcggcaggcatggatcgagttcatcgacggcggcggcatggtgtgggattgccagcttgccgagtacctgctgcacggcatgacgcaagagttccacatggcgagcatggacgagacggctccccgttacggcggcaacctgaaggacgatgcagtcaagtccctgtgggctgcgggagtggacacctgcgacatcgacaagacgctgctgatggattacctcctcggcaccaacgacaccgacgacgtgggcgacatcggcaacaccgagaagatgttcctcgggcagctcgccgccttccgtgcacgtggtggtctgcgctcggcgctgctcaacatgggcgcgctgtgcttcaccatcgaagccgagtacaacggcatgtacgtggacaaggaatgggcgcttgcgaaggcgaaggagttggaggtcgagcttgcaacagcgacggctgaactcaacggcttcatccccgagttgcccgagggcctgaccttcaactggaacagccgcttccacaagagcgcgctgatcttcggtggcaaggtgaagtacacggccaaggttccgatcatgtccaccgagggtgggccgacctacgtacagaaggacgaggtgcactatgtgctggtcgatggtacaacgacggcgacgccaccggccgaggacttcgacaacctgtggcggtacaccacctacggcagcggcaagaacaagggcgagtacaagaccaagaaggtgaaggtcgatgacttgaccaagcagaagttccgcaacgaggacatgctgttcgagttccccggctacaccgagccggatgctgcgtgggaaagcaagagcgatccgggtgtgtactccaccgccgccgatgtgatcgaggcgctgggctatcgcaacctgccgttcaccaacgcactggcccgccgcgccgacatccacaaggacttgtccacgtactacatcacgacggacgagaagaccggcgagcagaagggcatgctcacgctggtgggaccggatggtatcatccaccacaagctcaacatgaccaacacggtgacgggtcgcctgtcatccagcgatcccaacttgcagaacgtgagcaagggtgagctggacgaggagacgttggaggagaagggttctcagatcaagcgcgccttcgtgtcccggcacaagggtggcaagatcatccagtcggactacacctccctcgaaatctacgtgcaggctatcctcaccgagtgccgtcagctgatcgaagacctgaaggcgggcctcgacatgcactgcctccgtgccgagcaggcgtggggcgagcagggcaagtacgactacgacttcatcctgaaggcgagcaaggacgacaagcatcccgagcacaagaagtggaagaagaagcgcggcaacgcgaaggtgttctccttccagcgtgcatacggtgcaggcgtggcgaagatcgctgcgaccaccggcatgacggaggaggaagtcgaggcgctggtgcgcggcgaggccgagcggtacccggaactgggtgcttacatcgaccgcatggtcgaggccatcaagcgcaaccgcgtcagcaccaaccgcttcgttccgcaccccgacgccggacggcagggcgtgcctgctgggctgacgtgtcagctgggccggtcgcactggaccacgccggacggcaagatgtattccttcagcgagtcaccgtccccggtgttcatcgccaacaagcccgcgagcaagggcggctgcgcgcagtcgttctcgcccacggaaatcaagaactacccgatgcagggcaccggtggtgagtgggccaaggcggcgatgtacgtcagcctgcgcgccttctaccggaagtacgtgaccgaaccgaaggagtggttgggccgtgcgttgctcgtcaatcaggtgcacgatgccgtctacgtggatgcacatggcgacatcgcaaccaaggccgctgctctgctgcacgcctcgatgctggaagcgtcggtgtatatggagtggtggttcaactggacgctgccgcttggcgtcccgtgcgaaaccaagatgggcgacaacatgatggaggagaagaatcctcccgcagagttcgccggtctggtcatcgagtaccgagcgtcgatccgcaaggacttcgtaggtaatcacaacccgtcgtttgaataaggagaacaacacgcatgagtcttgacgcactgttgaacaaggtcgccacgcagggtaaggaccagtcggtcgccagtggtggcaacttcgactacaccccgcccgctgccggtgtgaccaccgcccgcatcgtcgggtactacgagctgggcaagcacgagttcgagttcgagggcaagaagaagacgcaggatgaagtcgccatcgtgttcgagctgaccggcaagcagcacccgcacatcgagacggacaatggtccggtcccggtgcgcatgacgctgacgctgggcctgtccaccaacgagaaggcgcactacttcaaaatcttcagccgcctgcgcaccgaggagcgccacttcgtgcagctgctgggtcagggtgtgctgctggaagtcatccacaagccgggcaagcgcgacccgaacaagaccttcgccgagatcgacaaggcttccatccgcaagccgatcatgccggtgccggaaatggagaacggcatcccgaccggcaagttcgtggacaccgtgatcccggtcccgcagcagatcaccccgctgggtgcgttcgtgtgggacttcgccgatgccgaaatgtgggacagcatcttcatccccggcgagtacccggagcgcaaggacgagaagaccggcaaggtcacccacgaggcgcagtcgaagaacaagacgcagctgcgcatcgctgcggcgctgaacttcaagggcctgccgtgctacgactacgccgctgccaagttggcgggcagcaccacggtcaccaaggaaggcgtcgatgcgctggacgaagtggtcggcgacgtggcgaacgctgcgcccaccgacgctgctccggccgacgacaagccgccgttcccggtggacggtagcgacccgatggcaggcatcgcctgatggacctgagcgctctcatggctgcggctggtgagcgctccccgatgccggtacaagtggtacgtcaacacaatccccgcgtgatcgctcacgtggatggggactacatggcgtacttcgcggctggtagcgagaactgctcggcgggggatgcacggcgcaacgtgctctcccgctgcgcacagctgaagcatatcagcggagcgggtaagatcgtcatgcacctgacgcacggcgcatccaccaagggtgaccgcttcctcgctgctaccacgcagccgtatcagggtcagcgccaagcaggccgcaagcccaacaactgggcgttccttcgtgagtggatggagacatacgagggcgacgctttcactcccaaaatctggctgacgcgagaagccgacgacggcatcgcatacgtcaacgagggtgcagcattgcaccacaacatcctgcacgtggtgcacagcgccgacaaggacatgcgaatgttctgcggcgtgcatgtagactgggaaggctacggcatcaccgaggttccgctcggcgcttacgacatcgtgggcgagaacgggttgcagtacggtcacaagtggttctggatgcagatgctccacggcgacaccgccgacaacatccccggtctgccgaaggtaggcaaggtgacagcggagcagctgcttctcgacacgaaggacaacctcgaagcggtgcagctagtgagcggcaagtacagcgaagtgctcggtgccgactggcgcaagacctttgccgaacaggccgtgttgctgtggatgcggacggatcgtgacgctgaactgctggacgtgctgaagctcgacgtgttcgggccgcagctgaagcaagcattctacgacctcgccgaggacgtgaacgagaagcgcgcaatcttggaggcatacaaagcatgaagcgactcactgcaacgcaggtcaagctgttgcgcatcaagctcgcagcggagcaagggaaccgatgctgcctctgtcagggacagttcggcctgaaggctccgctcgatcctgtgctggaccacgaccacaagaccggcgctgtgcgcggggtgctccatcgcggatgcaactccctgctcggcaaggtcgagaacaacgcaggccggtatggcgtgcgcgatgtgttcgcattctgtgcgggcatccccaactacctgcggtcccacctcaccaacatcacggggtacctgcatcctacctacaagaccgacgacgagaagcgcatcgctcgcaatgcgaaggcgcgtaagcggcggtcactcaacaaggagacaccgtgacccttacccagttcattcgccgagcaccgaagcgcggcccgaagattctctgcctcgacatcgagacgttccccatcgagttctacggctgggggatgttcaacaacaacttcagcgtcaagcagatcaagcgtgactggtcgctgatgtcgttcgcttgcgagtggctggacgatgacgagtcgttctatatggaccagcgcaacgtgcgtgatgtcttcgatgaccgcaagcagggcaaggcactgtggcacctgctcaacgccgccgacttcgtgctagctcgcaacggcaagaagttcgacctgcgcaagatcaaggcgcgcctcgccatcctcggcctgccgcccgtgtcgcccgtgcaggtgatcgacccgatgctgctgaaccgcaccgagttcgccttcacctcgcagaagttggagtacaccaccggcgtgatcgtgccggagctgcgcaagtacgaccaccacaacttccccggcttcgacctgtgggtggcctgcatgcagaacctgcccggtgcgtgggacgagtgcgaagcgtacaaccgcatcgacgtgaagtccatgaagttggagtacaagaagctgcgcggttggtactcgcagcatccgaacgtcgccgtgtactacaaggccgatggcagcgagcaccgctgcaacaagtgcggctgcaacgaaatgatcccgcaggatgatccggcccgcacacaggtcggcacgtacctcctgcttcagtgcaccgtgtgcgacggctacagtcgtgggcgtaagctgacgaccagcgccgaggcccgcaagcacatcaccgttccggcataaggagccgacatgaagatcaccgacatccgcagcggcatgcgggtacagtacaccggaaatgcgcccggcctgatcgggcggcgcgggaaggtaagccgcgtgttcgctaaggatgtcgaggtcttcttcgacggacgtgtgagcgcgagctactgcgttcccgattccctccgacagcttatgagcatcggaggtgtgaccaccaccagacgagaggtacccatgcccgaactgaactaccgcaacgaggacgagcgcacgctgtccgaccgtggcgtcggcctgaaagatgacggcggcaagccgcaggctcggctgctgcatgagggcgtgcctcgtgcactggcccgcgtcatcgacaccttgaccttcggggcgcagaagtacaaggcgcactcgtggcagcatgtcgagaaggcgctcgaacgctatcaggatgcgagctaccggcacgacaacaagcgctgcctcggcgagaagctggacccggagacgggcatccatcaccgcgcgcaccacatcatcaacgagctgttcctgttggagttggaactgcgcgaggaggagcaggcccgtggcgcagagtaagggtcgctcgatcaaggaggcgtgggtcaacatcgccatcgggtacagcatcaactactgcgcgaacatcgcgttgctgccgctgctgtggcatcccgaacacccgcttatgtcggcccacgccatcggcgtagccttcacgcttatcagcttcgtgcgccagtacatcatccgccgctggttcagcaagggtgactgatggcctgcgcccgctgcggccaagtgcaccggtacgtcccacatgaggccgagtgggcgcgcttcctagaggagcatcgtacccgcaagcagttcgatgtcgagtgggccaactcactctggcatcgcacataccctgacgacgccttctgcattcttgtgatgaagggccgcgcaggtttcgttccattcccgtcgaaggagaaatgaatgctctacaagaaccagaccgccatgcttatcaagtcctacgagaacaccgtggcgtggggcgagagtgccgaccacgaggaggcgttgcagaacgcggtcaaggcgggcttcccgaacctgccggaagaagatcaggccgagctgtatacccgcatcgccgatgcgtgggaaggctaccgtggttcgctcgctccgcgcaagctgtggatcggcaccatcgtcaaccagttcatgtcgtcccgcatcgcacggttcaacgccgcactgggcgatggcagcaagaaggaggacagcgccgatgtttgacatcaagcgagataacgtgcgggtcgctcccggctacaagaagcgcaagcgcggcttcaagatcaaccgcgccttcaccaagggcaacttccgggtgacgtggtacgacggcaaggccacctactgggagcagtacgtgccgtggtacaaggtgccgctcgccatgttccagatttggagggaccacgcatgagctacatcgtccacaaggcagtcgagcaggacaagatcaagaagaagctgcgtcccaccgaggagcagctgcgcaccgagtacatcgcacagcccaagtacgacggctgcaacatggtcgccatcaagcgcggccactgggtgcccaccgtgaacaagggcctgcacgccatcaaggtcggcgacgtgcagatgcagcccgtggatcgcggcgtggtggacctgttctcccgcaccggcgagcaggtggtcagcgcgcaccacatcgagaacgctctcgcttccgcaccgttcttcccggtcggtgtctacttcggcgaatactggcacccgaccatcgaccagcccaccgtcagcggcatgttccgcaagaaggacggcacgcagtacaccgagccgatgttcgtggtgttcgactacgtgacgctggaagaatgggagcagggatacagcgacctcgtgtatcaggagcgcgtcagccgcctgccgagcatgggccacgccatcgccgagggtaccgctcccgtgttctacgccgagtcgcagggcttcctgatcgaccaagagctgggcagcatggaggcggcgaagctgctgtgcgagggtggagcatacgatggcctgatcctgcgcaagccgagcggcaagtgggtgaagggcgacaagggcacgaacggcgaagtcgtcaaggtaaagcccacaatcacgctggacctccgcgtcgaggacatcggcgtcgaggttggagagaagaccggccgcaacgtctacaccctgtgggtccgactgccgaacggcaaggcgcaggaggtgggaagcggcgtgccgcaccatggcaacggtgttccgaaggtcggcgacatcgtggaaatcgaggcgatgtcgtacagcaagttcggtctgctgcgcgagccgcgcttcaagggaatccgctacgacaagccggaggctgaccaatgagcaacgtcaagaccgaggtgtggcacaacatggaacgcgacacagtggaggtgcgagtgagcatcccgttccgcgagtacgccggttccttgtggccgaacgagacggtgcgcgatgcggtgatcgaatcgctggatcgcttcctcgccgagcggaggggctgatggacattcgattcggaaagcccgagctggatttcggcggtgatcgcttcgctccctacggtggaggtcatgtaaccgtgactgccactgcgtggtgcggcaccgagcagttcttcaaccgtcagtgcatcccgagctacgaggtcggcggcgacgcatggccgcacatcatcaacgaaatgcacaccgcactggtctgcatgatcctgaagcgttacccgccgacggacttcaccatcaagcaacggaggtagcatgctctcgcaagtggaactcgaactggaaacctacgccttcggtaaggagcgcatggagaagtccatcgcccgcaacgaggagaagggcggcgcggacaacaacccctacgcccaagcagtgtatcgccggttcgtgcttccgcttgcggagcgcatccgtgcggacatcgactccccgcgcatcggccgcgcccaagcgcacgtgccacttctgcgcgccaagtacgatcccgagcgtcagaacaagagtggacaggccatcagcgccgaggaacaggcccgcgagtggtacgaggctgtggccttcgtcgccgttcgcggtgcccttacctcttgcatgcgtgacaagcacggcgaaggcagcgaccgcgacgtgctgaagaacgtcggcatcaacgtgtaccacgagtacctgctgacgcagttcgccgacgcagagccgacgctgttctaccacctgatgaacgacatggaccgcaagctctctgtcaacgagaaccaccgcatgacggtgatgaagatgcagggtcgcaagaacggcatcgagttcgtggagtgggggcaggcgcagcgcgatcaggtcggcgcgtacctgtgcgaccagcttgcacagctgggcatgttggagattggcgtagtcaccgagactgcggccagtgccggtgcagcgtaccggaagttccagaccaagacgcacgtcaagatcgtgctgaccgacgaggtgcgcaagctgattacgcagatcagcgacttcgtgatcgaggccacgccgttctacctgccgtgcgttgagccgccgatggactgggtggacatcgacaacggtggattccacacgaaggaaatgcggcggctcaatccgtggatggtgaagacctacgctcagacgcgcgacgagtaccgcgccgccgagctgcgcaacgagatggctgcgatcaacgcattgcagcgcgttccgtggcgcatcaacaagcgactgatggaagctgtgtcggccatcgccaaggtgcacgacatggaggaaatcatttcgcagggcgagctgccgaagccgcgaaagccggagtggttgaccaaggacatgaccaaggaaaccatgtcccacaatcaggagttggagttcaagcagtggaagcgcgacatggcgaactggcacaccgacgagcgcctgcgccagaacaagggcaatcgcttctacaacgcaatgaaggtggcgcgtaagttcgctgagtacccgagcatctacttcgtgtacttcgcagacttccgtggccgcaagtacgttcagaccaccggcgtgtcgccgcagggttcggacttgcagaaggcactcttggagttcgccgaaggcaagcccttgctgacgaaggacgcgcaggattggttctgcatcacgggagcaaaccgatggggttacgacaaggcgtcgttgccagaccgagtgaagtgggtgcgcgagcatcacgaccagatcatggccttcgctgcggacccggtgaacaacgacgagtggaagacggccgacaagccgttgcagtttctgagctggtgcatggagtacgagcagtggcaagtgttcggggatcgcttcctgagccgcatcgcagtcgggatggatggttcgtgcaatgggcttcagaacttctcggcgatgctgcgcgacgcagcaggcggggtggcgacgaacttgatcccggcaccgctgccgaatgacatctaccagatggtcgcagaccgcgtgactgcgatcctgctgggcgaggaggaagacgccgaagggtaccgcacgctgtggctcaaccatggcctgacgcgctcgctggtgaagcgcagcgtgatgactctgccgtatggctcccggcagtcctcgtgggcggacttcatcatcgaagactacctgaagtgcggcaagttccccacgctcgacaaggccctgtacggcccagcagcgcgcttcctgagcaagcgcatgggtgaggccatcgccgacaccgtggtcgccgcagcgggcgcgatggagtggttgcagcgcggttcgggtgcgatcctcaaccaagggtacgaccgcatccggtggatcacgccgtccggcttcccggtggtgcaggtgtactgggaatccgaggagcaccgcatcaacaccaagctgtgcggtaacgccaagctgtccctgcgcaagagcacggacgcggtgaagaagtcccggcatcgcaacggcatcgccccgaacttcgtgcacagcctcgacgccagccacctgacgctggtggtcaacgccgccaaggccgaggggatcgacgccttcgccatgatccatgacgacttcggcacccacgccgccgacagcgcggccctgtaccgcatcatccgggaggtgttcgtggcgatgtacgagcggcacgacgtgctctcggccttccactcagcctacccgttcctgccggagccgccgccgatgggcgagctggacctgcgccaagtccttgattctccgtacttcttcagctgacggagtttcagtacacctatagcacacaggccaaccgaggtccggttggagcggccgcgattgtaagcggaaccggtgccggaccttttggtacacctatagcacagaggagacaccatggccgaagacgccaaagtgaaagtcctgatgacgctccacccgaaccagcttgccgccgtgcggcgactgtccgggctgtcgctgtccgtcaactcgaataccacgcccttggaggcaggtatgcagttggggatggcccgcgtcctgaacatcttacaggagggtttcaccgttgatacctccgtaccgaacaccaacgacgggtgatagtgagcagatcaaggcggctttaacggccgctttgtatctgtcatctagagaagatagtaaggtagacaacagagagtcttctgtaagctacaactgtgatgatcctgattatacagtagctctgataactcagaacttagtagatgcagtcatcatagatgaagcctacctgctatgctttgccattgtcacaccgtggtattccaagaaccgtactacgttcgttgagaacatggtgctgcgcattgggccgggcagttccttcgaccggtacatagccgtgatggaacatctggctgacatcaaccactgcgactccctgagcgcaggcggtgcactagctcggaactcccgagcactcacacggatgtatgcacgctacggctacctgctggaacggcatgctccccaattcaccaagcgaaggagttaacctatgggtagcatcgttggtggtgggtctgcaaagaaggctgcgctgaagcaagcggcggctatcgacaagcagaccaacctccaaactcaatccacgaactaccagattcaggcgatggccgatcagatggcgcaggcagctgcacagcaggccgcatccgagtacgccgagaagttgctgagtgcccctgtcgataccgtcgatgtgcgactgggtacttctgacctcgacttgcagaccgccgacctgatcggccgacgcaagaccgcccgctccacctacacccggcccgtgaccacgaccgcagcttcccggctgacgaccgtggccgggtcagacctgttgtgaggtgagcatggaccattcgatccaaaccgctcaccgccagttcgaggcttacgacaacaagcggcagggcatcatgtaccgactcgaacgctattcgagctggactgtccccaagctgttccctcgcaagaaccgcgatcaggacaccgagccgctgacccacgggttccagtctctcggcgcacaggcagttaaccatctggcgaacaagctgatgatgtcgctgttcgcaccgtcccgaccgttcttccgattggagctgaagcgcaaggcgaagcaggctgcgcaggaacagggcgcggacttgcaggccatgcaggcaatgcttgcgaaggccgagcaggacgccagtctcgaactcgacaagcgctcgatccgctcccgactgtacgacctgctgaagatgctgatcgtgctgggcaacgccctcatggtgttggagaaggacacgatccgcgtgctcaacatgcggcactacgtggtcaagcgcactcgcactggcgaggtctacgaactgatcctccgggagaaggtgcacaagacccagctggaacccgccgcactcgctgctattgtcgcacacccggacttcaagcccgatgacgacggcatggtgtgggagtacaagtgggtcaagctggaccacaagaccggcaagtacaacgaagacgtgtggatttgcaactgcaagctgcccgcaaacttctcctcgacctactccgcagacaagctgccataccgggcggtgagttgggacttggccgcaggcgacgactacggctccggcttggtcgaggactacgaggcagacttccagtctctctcgatgctgtccgaggccgcagtgcagggcgcgatcctcgcatccgagttccggtggctggtcaaccccgcaggtcagacctccgtcgaggacttcatggcatcgcccaacggcgcggccatccccggcatgaagggcgacatcgagctgattaacgcaggcgtcgatggcgtgctgcaaaccaaccaagcaatccagtccacctacatcaaccgcatcggcgcaggcttcctgttgcagacggcggtgactcgtcaggcggaacgtgtgaccgcgcaggaaatccgcatggtcgccgaggaactggaaggcgggctgggtggcggctacagccgcatcgctgcggacgtgcaggtgccagttgccttttgggtgatgaacctcacgggccgcgacatccgaggcaaggacttggagcctgtcatcatcaccggcttggccgcgctctcccgaacgggtgaccgtgaccggctgttggagttcggcagcaacctcgcaaacgtcctcgcgctgccgccgcagattctcgaacgactgaagctgtccgcgtggatcgccgacctcgccgccgctggtggcttggacccgaacgtatacgtgctgactgaggccgagtacggccagatgatgcagcagcgtgcgcagcagcagctggtcatgcagaacgcatcgcagcagatcgacaacgccaacaacatggagacacagacacaatgagttccaacgcacctccgggcggtggtcccggcgcaaccgtgatcgcaacctcgcacggcaaccagcccgccccggcagctccggctccggctgacgacaagctgctgcccaacggacagcccgcaccggctgcaccggcacagcccgcagctcctgctgcgcctccggctgctgacgctctgagtctcgaacccgctgctcccgcacagcccgccgccccggcgaacgctgcgccgactgctgtgtcgattcccgactacggcgacaacggcctgaacatcgcggccgaatacttcgtcaacaccgtcggcctcgacatcgacagccgcgaactgaccgaagcagcgaagggcaacttcgccctgctggaagccaagctggaagtcctcggcgataaggccaagggttccgcaccgatcctcgctctggcgaaggagagcatcgctcgtgtcaccgccgctgcaaccgcagcgcatgccgcgaacgttgctgctgtccacgaagccgtgggtggcgcagagaactgggctgcgatccagcagttcgcacgggccaacctgcccgccgaccaactgaagcaggcaagcgaatcgctgtcggctggtggcttcggcgctcaggcgaccgcgcgttacctgatggctctggcacaggccaatcccgcgacgaccgtcaagggcgcaccggctaccaatgccgccgctcctgccgcgtcgatcaacggcgtcgctcctctcacgaaggagcagtaccgcgctgagtaccgcaagctggttgccgagaagggcatccgtggtgcggcccactccgaagaactgcgtgcactcaacgcgcgcgtcatccactaagaaccaaggagcaacataaagcatgagcaccatcttcccaaccgtcccggttctgccgaatcaggtcaaccagtccggcaacgagaacgcgctgatcctcgaacagttcaccggcgatgtcgagcacacctacgtgtccagctcggtgctggaaaagttcttcccgcgcaagcaggtcaagggcaccaacaccctgaccaagaaggccatcggccgcaccaagcttcagaagctgaagcgcggtgatgcgccggacggcaccccggtggacttcagcaaggcgtcggtgaccgtcgataccatgctgctgtcgcgtcacagcatctggcagctggacgaaatcttcaccgacatcgacacccgcaaggaaatcgccatcgagcagggtcaggaaatcgccgagttcgtggacctgaccatcagcatcgccgccgccaaggccgctgctgccacgcagtcgatcttcacccgcaacggccgcgcgccggaaggccacttcggtgccacgcaggtggtcctgtccgctgccggtgacgagaacgatccggccaaggtctacgccgccatcggcaagctgttctcccgcatggaggaggagaagaaggtcaagccgcagcgcgacggcgtggtcctgatcgtgcgtccggcgatcttctacctgttgcagcaggccgagcagatcagcaacggcgagtacctgacctcggacggcaacaagctgaccggcatcccgaccttccacggctggggcgtcccggtgctgtcgagcgagaacctgccgaacaccgtgatcgaaggtcacctgctgtcgaacgacgacaacgacgacttctacgacggcgacttcagcaccctgatcgccgtggccgtgtcgccgaaggccctgctgatcgccgaagcgctgccgttgcagtcctcggtgtggtggagcgacgcctcgaagtgctacttcgtggactcgtggatgtccttcgccgttggtctggatcgcgtcgagaacgcgggccgcatcgacaaggttgcctaatccgctgggcgcggtccctgaatccttcgggtaactcaaaccgcgcccgccttccaccaacacaggagcaccatcatggtctttgaccgaccgttcgagatttccaaccgcgtcgtcgccgctaccggcgtggccggtctgcccgacaactccgtgggcaccgtcgtcggcgtccactacgacgccatcggcgcgggctgggtcgtgcgcgtccgtttcgttgacgacgaaatcggctcgcaggacgtggagtacgcaccggcctcgctggctctggctgcggactaagcaacatcccggcaggggcgctacggcgtctctgccttgttcctctcaggagacaccatggcattcatcaccaagctcgacatcgtgaacgcctgcatcaagacgatgggcgagacgaagctcaacactctggaagatgaccacgtatacaaggacgacgcagttgacttgatcgaccgcgtgcaccgcgacgtgtcgtcgctctcgctgtggttcaacaccgaatgggtggagctgaaaccgcaggcaacgagcaagtacatcatggtcccaacggacgtgctgaagctggactgcaacccgagccgattcggccacgtggtgcagcgcggacgccgcctgtacgaccgcaagcgcaacacctacgagttcgaccacaacgtgcaggccaagctggttcggctgctggacttcgatgacctcccctacgaggtgcagatgttcgtgcgggacgacagcgtgctgcgtttccagtccgacttcgacggcgacaacaccaagtacgccaagatcaagcagcagcgcgacgactcgtggatcaacatgaaggccgagcatatccggcagatcaaggcgaacccactgttcgcgcgtgcgtccgtggacgtgctgcatcagcggtacttcaactacagcggacacccgtggcatagccactacactttccccggctaaggaggcaacatggcaaaggcaggcggaacctatcccgacatccttcagggtgtcagtcagaaaccggcgcaccgtcgtcggccgggccagacgcacgagcagatcaacgtgctgtccgatccggtgaacggccttgtgcgccgtcgtggtacgcggttcgctgcttcccaagccgttgtcacctcggccgagctgcgcaacatggacgtgttcgacttcatgcaggaaggcaaggagtacgcgctgctgtatcggcgcgatccctctacctcgggaagcgagacgttcgcgttcctttacaacaagacggacgaggcgttcatcccgctggtctacgagaacagcacgtgggtcaacacgctggtcagcggcggcgcgtcgtcgctcgcggccatcggcagctacgtctacatcgcgggcaacaccacgatcccttcggccaccagcacgaacgtgtggcaggagcagacgaacatccagcgcctcgccgcgtgggttcgcaccggcaagtacaacacaacgtacacggtgaacctgacgcgcacggacaacacggtgctgacggttacgttcaagacggtgaccgcatcgtaccccggcacgctcgacacgagcgacatcccgttctacctgcccggtggcacggagccggacccggcgtatcagaagtacgtcaacgaccgagtgaacgagtacaactccgcagtcaacgagtggatcgtgaccagtgccgagcagacgcgcccggagtacatcgccgagcagctgtcggatttgctggtggacgcgggcgtggcggctacccacatcaagggcggcatcatcattgacgacgaccagttcaaggacatcacggttgacgacgagggcgacggcacgaccttctacgccgcagggcaggagattaccgacgcgacctacgctgtcaagttccactggcacggcaagatcatccgcgtgcgcccgagcggtgcaggcgcggacgagacgtactacctgcgtgccgagttggagaacggcgagacttcgggctacggctcggtggactggtacgaagcgcccggcgtggagtgcaccatcgacaacctcgtgtcgcagctctacatctacaacggtgtgggctacatcgcacgcaacggcgcgggcctcacgtctctggctccgggcagcggcgagcacccggcttacggtgcgcgggttgcaggcgacggactgacctctccgatcccgtggttcatcgacaagccgatcaccatgctgtccgtcttccaagaccggctggtggtgggcgcgcagaactacgtcaacgcctcgcggtcggcggactacctgaacttctggcgcggctctgccgtcaccatcgaagacagcgaccccatcgaaatcttcgcgcatggcagcgagggcgatgtgctccggcacgccacgctctacaacggcaacctcgtgatcttcggtgaccgtcagcagtacgggatcagcggcgactcggtgttcagtccgaagaacccgcttatcaaggcgttcagtgcgaacaaggattcggtggacgcgaaggcgcagacctcgggcaactacatcttctatgcgcagtacggcagcgaaggcacgagcctgcaccagatgcgcgtcggtgcgctcaacggtcagcagacggtgacggacgaaatgtccaacgagctggactcgtggctgtccggcacgccgttgcagatcaccgcgctcactgccccgaaccttgtgatgttccgcacccgagagcacccgcaggacttctacctgtaccggtacgaggacaacaagaacaacgggcagcgtatcgtggactcgtggtcgaagttccagtaccacccggcgctgggcgaaatcatcggcgtcagcagctacaagaagaacggcctcgtattcaccgcacgcgggtcgctggtggcgtgcgacgtgttcgacccgaagggcgagccggactcgcatgcgtgcctcgacagctgggcgagttttggtacacctacgggcgtactgaccgcgagcgcaagcatcgccgtcaatagcactagcccgtacttcctgctgggttgtccctacgctcaggcgtcggacttccttagccagttcgatgacctcgatgctggtgcgctggaatacggcgtcgtgtctgaggcgctggtgatcccgaccaatccgttccctcgggaccagaacggtcaggctgtgctcgatggccgcatgtcgctgaacaaggtgacggtggacgtggagaacacggcgggcatgctcgctgcggttaccacccgcaacaacagcgtgaccaccacggacttcgagggccgcatcctcggcgactccgacaacctgatcgcgcggcaaccggtgtaccgggggcagctgaacatcagcgtcgggcgcgaagtgcgtgagtgcacctacgagattcgcagcaaggattggctcccgctccgggtgaccggcctgagctggacgggtcagactttcaacaatgtacggagggttagctaatgggttcggttaatacgatcctgcaagcgaacaacaccacccgcgttgcccgtgcgaactaccgtgcagccgttgcgcagaccgacaacacgaaccgcagcgaggtcgccaagaccggcttcgctgatttcatgcggtccctgaagaacaacgcccagctggacgccgccgcgaaggagtacaactccaacatggaggcgctgtccgaggagctgcgtgcacgccaaggggctgggcttaactcccagctccaactggcgaacgcgcgcggtgcgcttcaggcacaggccggtgctgtaggtgtgggcggctcgtccgcagacctgatggataccatggttcgcttgcaggcggaaatggacaaggagacgcaggacaacgcagtctcgctgctcgcctctcgcggcgcatcgcagacggcgcaggtcatgtcgcgcgcgtggaatgggatggacatgagccgcacgttcggccagttcgactactcgcagcacatcgagccgaaggcgatgaagcgtcgcttgggcaagctgatcggcgtggccgtggctacctacttcggcgggccgatggcaggcgaggctgtggcagacttcgcagtcggcacgtggcaggcggacaacggcaacttccaaggcatgtcgcagtccttcaacaacgcagcgcagaacgggatgcaggcgtggcagcagtccaatgatcgcggcggcaagtcgtgggcgtccactaccttcgggtacaacgacggcaccggcaagcagtccgtgaccggggcgaaggtcaccggcaacttcggcaacaactacgacaacttctccaccactacgtccggcctcggctggttcgacagtggcagcggaggcaactcaggaggcgcatggtaatggctgacatcggcacggttaccttcaacacgcagtccgcattgcagggtggcatcaacgccacccccgcactgtcgggcaacaccagcattcaaggcgctggtgtgaatcaggtcggccccgttcgctcgggatcggattggttcgagagcactggtggtatgacgatgccggacagcaacctgcccgagttcttgcaggaactggcagcgccgaacaccgccaagctgaagcagcagcagatgtgggacggcttcgttgccgcccgcgctggtaagaccatggacgagattgctgcgaccgagccgtggtacaagaaaatcttcggcgacaccaactacgagattggcgcgagcatgtataacacgctctcgcaggtcaacgaaatggagagcgacctgctgcggcgtatgccggagttgcgtaagcttccgcccgaggcgatggcgaaggaattcaacgacctcgccactgcccggatgaccggcaacggtttcgcggacacggtgttgcagaagaccttcatggatcgcgcgggttcgctgatggacctgcacacgaaggagcgcacggcgtggcagcagcaggagctggtgaaggcgcagtacgctgcgaactcgtcggcgtccactggcttcaacgaactggcgaagcgcacggcgatgctcggtaccaaccgtcccatggacgagaaggccaccgaggcgctgacacaggcgcagctgtcgttgctcgacggtctgtcgccctcgcgttaccagacggacgagtcgtacaagtcggcgatcaccgcgttctaccgtggcgctgcggatcgcggcgagttccacacgctgaagttcctcaacagcaagggcgtgctgaacgccatcgaccccgacgggcagctgggaatccagcagtacgtgaagcaggcgcaggatcggtaccgctcggactggctcgatgccaacccggagcaggccgagaagatggcgcttgtctccatgtacgcatccgagggcattggtgccaagccgtcgcaggcgatgatcgaggaaatgaacgcgacctacgccgctgagacgggcagcgatgcgccgctctactcgggcacgcagcttgcttcgatcatggcgcagtccgcaggcgcgcacatccgcgcgcaggaagccgtcatcaaccagcgcaacgctgcggctaaggctgcactgactgaccagcagaagctggcggcgcaggaggaggacatccgtggcggcatcgagtcgttcaagcgcggcacctacgcgcagacgatcaacatccccggcgtggacaaggagctgatcgaagcgaacgtggtgcaggcgtggaactccacgatggccgcgaacccgaaggtcgccatgtcgcagctggtgtggaacgccaacacagggcgcggcgctgtgctgaagggtgtggccgatcagttccagaccacggcgcgcgctgtgctccgcgatcagccgaacacggcagcggctgcgctgtaccagcagtggaaggaactgaagcagacgaccgctgcgcgcatcgacacgaacggtcagcctgtgcagggccgactgactggcgcaactaccgccgcgctgtacttcggagatagcgtcaacacgttcttcaacaagctgcaagcgttggagaatggcggcgtgaacttcgagcttgcctacgaggtggcccgtggagaaatcaccaccgacgatcccacgcagttcgacgcgaacagtcgtaaggaatccgaggctactcaggctcgtgttaacgacgctatcgcaaagctcaaccccaagtacctcgggatgttcggcaacaagctgggcgactctggccgcgctgcgtatgctcgcgccatcgtccggtcggtcaccgacagcggtgggctgctggacacttctgcggaaggtttgcaagctgcggctacccacgctaagctggcctacggtctggaagacgcgggcaagtacgcatgggagaacggacgcgacgacgaaggccgagtgatcggcggtgttggtgcgtggctggggttcatggacacgaaggagacgggaccggccatcgagaaggccatcgacgcagcactgcggcgggtcaacatcgagcctactaccagtctgaaggctgacgtgttccgcatgaaggacagcgagaacggcgagccggtgctgtacgtcaacgctgttggcgagaagggctggaaggttgtgccggtgtacgggcgcgacatcaaggccgagtacgagaagcacacgaagcagcagcggcagttgcaggccccggtaccgcagggctacgttcgcatgaacgacggtacgattcagcagagcatttccatccaacccaaactgtaaggagatagacaatggcactcgatctttcggggctgacccaagaccagcagattgccaaggctgccgcttatgcgggagtgccggagtccatcgtgcgcggtcagtggcgagtagagtctggcaacggacgcgcagccaaggacgctgacggtgtgatccgcagcaaggcaggagcgcagggcgacttccaagtcatgcccaccacgcaggcaacgtgggaagcgcgcaacggtcgcaagtacgacatgcgcaacttccaagacagcatcgagctgtacgccgacatcatgcgcgagaacatgcagcttgccaagggcgacgttaccaaggcgctgcgcatctaccaaggcggcaccaacccgaagaactggggacaggagaacgcagcctatgcaccgagcgtgctgggtggcgcatccgctcccgccgtgtcggcgcagccgcgcagcctgaccaccactcaggcagacctcaacgccgcgtggcagggcaacccgaacatgcgcgaccgcacgtggtccggcgcttccatcccggatgcgtggaccggtgctcccatcgaaggccgcaacgctctggcgtcggcagcgaaggaacacatcggcaagattcgtgcgggcatcgccgagctgtcgatgggtcaggtggcgcaggaaggtggcaccgcagagcaggctgtgggcaaggcgcaggccgtccgtgcgtcggatcaggtcgtgccgtggtgggtgcgtcaggaagtggacgtgctgaataccggcgctcgcaaggcgctgctggatcagaccgagcaggctctcgcacaggagcgtgcagacgaggagctgcgcaactcgctgaccttcctcgacaagtggggcgcggcattcgacagcggcatcggtgcggctatcagcaaccagcttgcgcgcgaggacgagaacatcccggaaggttggaagtacgacccgaaggaatgggagaagtcgtggatgaccgccgacgaactggaagacatccgtgacgctgcgtactcgccgaacgagctgaagtacgtgagcgaccgccagtggatgcgccgcaactccatgcgcatcaaggatcagcagaccggctggtcgagcttcggctacgacctcgtggcaggcttcaccgatccgggcaactgggctatcggcggcgtcaccgctgcgggcgctaaggtgctgggcgtgggttcggctgcgctggtggccgaggggcgtgtgggtgcttcgctcgcatctgccgctgcggagaacgcggtaggctccgtcatcacggacgccgctctggtgggcatgggcgagcgccgcaacttcgcggactttatgaccgacgctgcgttcgctaccaccatcggtaccgcgatgcacattccgggcgttcgctcggctgcgcagattcgggacaaggctaccatcgacctgtccgcaggcaacgctgccgcttacggcgaagcgtggtcggctgacctgaaggcgcgcgcggtggccgagcttggtgacaacgccaacccggtgctggtcaacaaccgcatccaccagcttgccaagcaggaagcagtcgattggctgcgcgctggtatggctgatgtgccggacgacttccgcatcttcgcgcgtcccgacgtgcaggagacgaccaccaccgcaggcaccactggtgcactggctcgtgacgtggacaacgtggacgcctcgaccggccggtacaacgacagcgtgggtggtcgggtagatcagcatgatccgctgctggaacgtgcgtggaaggccgcaggcatccgtggcggcaacgtggacggcgtgctgaagtatctggaatccaacgcctcgatcccagaggacgtgcgtgctatcgccaatgcgctgaagcgcggcggtcgcctgagcacggtgaagatcgtgccggagtcggaactcgacaagtggttcgccggtgccaacatgggtccgggtatgcgagtggccggtggctacaacgccgggctggacgcgatggcgatgcggaactacacgccggaagtggtggtgcacgaaatgctgcatgctgccaccctgcgtgagctgcgcagcaactcggtgttcggtcaggaaatggaagaactgctgacccacatcaacaacagcatcggcagtgtagactccacgctcaccaccgctgcaatggagacgcgcatcaaccagccgcaggcaggcttcctcgccaacaccgacgagctgatttcctacggcctgacgaaccgcgccgtgcaggcggtgctgcgtcagatgcctgcgccgggcaacacccgcccgaatgcgtgggagtggctgaaggacaagatcgcgcgagtgatgggcctgaagaatcaggagtccgctctcgaacgtctgatgtctgtggtcggcgacaacctcggtgctgaagtgcgcgacacgcaggcatcgactcgacagactcgtggcatgctcgccaactcgatcttcaagtcgaaccgcgagcgcaaggcgttctatcagcgcactggtctggacaagtccgtcagcgacgacgcgatgcgcgtgcaggttgccgaggtgatggcgcgctctgagcgcttcagtgccaagtacggcatcgacgcggcgaagctgtccaccatcatgcagcgcttcgggctggaagctacgagcacgaccctgatgtcgtccaagtcgccggtcgctcgtatgcttgctgtcaccctgttggagaacccggagggtgcggcaggccgacacagcacggcggcgatggatcggcatggccggttcgagtcgttcatgggtacgcgcccgcgtcagtgggaagcggcctaccgtctgtggcgcgcggacgttcgcggcatcggtgcgatcaaggacttcgccacgggctggaaggcacgtgcggacttcgagtacgcagtgaagctgtaccgcgagactcgcttcaacggtggggacatcccggatgcgcacgaggcagtgaaggcaatggcccgtgagctggaccgtggctacaaccgcatggcagcagagcagcgcgcggctggtacggtgggcgcacagcgtctgccggaggaagacgtggagggctacgagtcccgcacttggctgggtggcagcatcgctgctgctggtccggttcgccgtgagggtatccgtcaggcaatgcgcgatcagttcgaggtgatgggcgagctgtatggggacgacttcctcgacaagttcgctaccaagtatctggaacgcatcgagcgcaaggcggcgggtatcatcgaagcgccgggtcaggtcttctcggagtcgcaggcggacacgctgcgcgatactctgcgggcgatgtcgctcaacgaggaggagattcagaaggtgatgggcaagtacagccgtggcggtgcgaagcacaccaaggcgcgtatcgacctcgacgtgaccaagcagtacgaagatgctgatggcaagttccgcctgatggactacctcgacaatcgcgtgatggacaactaccgcaagtacgcgggccgtgttgctggtgacatcgctctggctaagcacggcatcctcggtgatgcaggcatcaacgtggctcgcgaagcaatgcgcctgaccggtgcgactgacgtggagctgaaggcgttcgagcaggtgatgtccgagttccttggtcgcccggtgggcactggtgatccgactgttctggcgaatgcgcggctgctgacctcggctatccagctgggcggcgcgggcatcaatcaggcagcggagtacagcaacggcctcgccgctgttggtgctgctggtgtggctgacgcaatccgtatcgctcctcgcatgcgcagcgaaatcatgcgcatcctgaagggcgaggacagcggcaaccaaatcctcgacggcttcgagttcatcagcggtcgcggcttcggcctcgccggttacgatctgcacatgttcaactcgctggacacgcaggcgtcgatgtacggcagcgagcgcgcaggcttcctgacctcgctggtgcagaaggcagcgcatgcaaaccgcatcctctcggggcagcgggctgtgctcgccgtacagcagcgcggcttcgcggaagtgctgatcgccaagggcgtgaagttcctgcgtgatggtgccgaggccgacaccgccctgaaggacatgggcattgacgacaacctgctgaaccgcctgcgggcgacgcaggatcgggtcgtgcgctggggcgctgacggtaagctggaagcggtggacccgcgcaacgtcgaaggactggcggatcggcaggcatggttggcgttctacaacgcgatcaaccgtggcacctcgcagattcttcaggacaccttcatcggcgagactggcaagtgggcgcacaacggctggctgaagctgctgttccagcaccgcacgttctcgctggtcgcacagcagaagcagctgggccgctacgtgggcaactacggtgcgtggcagactgcgggcctgatcgctgcggcgatggccgtggctgcgccgctgcaagccctgcgcgtgctgtcccgcgtggccctgatgaacgatcaggagcgcgacgaagccatcgaccagaacatcctgtcgcctctggcgctgggcaaggccacgctgaactacgtgtcggcgacgggcatgctcaacgatgtgctggacgtgggcaccggtgtggctggtggctggtacgagtacgccaccgatacgcagggtccgacgtggctgaagcagctggccggtgggcagttcggcaaccgcaaggaagtggtgggcgggcagttcgcgcccgcgctgggcgtcgtcaatgacttcgctcaaggcatcgctggcaagccggagaatctggccgacgtgattccgggcgggcgactgcccatggtgatcccgctgttgaagggcgcggccagccagtggaaggaggagtgagaatcagggccaaggacggcccacccttttggtacacctatagcaaacaggaggcagcatggcagttccagacccgcagctgcgctacgcgacagacgtgttcgacgccgatggcgtgaccactgactggcagatcagctttaccggtggctacatcaacccgtcccacgtgtacgcaatgagcggactgttggacgaggagactcagctgctgaccgaccggactccgcacaccgtggaagtcctgagcgaagacgatgacgctagcaccgtccgtgtctcgcctgccgtcgccgctgggcgcaagctctacatctaccgcagcactccggtgcagcagatgctcgttgactacgttaacggtagcatcatcagcaagaccaaccttaacctcagcaacgaccagctcctgaagatcattcaggaaatgttcgactcgctcaacatcgccacccttagcatcgaccaacaggtcggcgtgatcgtggacctgaacgagattatccagaacatctataagcaggtcaccgagttgctggccgctggtggtatcgtgtccgtcgccccgcgcgtctggtccggtgcatggaccggcgatcaggtggacgacaccgacttcgacatggtgggcgcggacgtgtccggcgctggcttctacgacgtgtacgtcaacggaatcggcatgcagccggacgtggactatcaggtcactctggccgacgacaccgatcccagcttcatccgcttcgccacggttcccgccgagggcagcatctggttcgccgtgctgcgtggttacgccaagccctacaccgggcctgcgccgatcactgctacgagcctgcgggtgccgatcatcccggcagaaggtccgacctactacgccgacaaggctaccgagtacggcctcgtgcggtgcacgtatgccggaggctgtgccgtcaacatcaacctgatccccgaagtgggcgacggtgagacgaagcttgcctcgggcagttacttcagcgttcagcagaaggcaggcccggtggtcatcactggcgacgtgggcgtgaccctcgaagtcccggtcggctgcaccgccgcaactcgcggcaccaactccgtcgtcactgcaacgtgcatcgacggcgacaccaacacgtggttgctctcgggcgacttggctaaggagtaagcatggctaatcacttcaggctgtacggccgaccgctgatggcggacgaggttgcagatggcctgtcggtgacgggcgtgctggaagggtacacggcgggcgaggcttacgagtctcgcctgtccatcaacaacccagtcggccgctgcaccgtggaggtcatcgaatcgacgctcccttcgggcgctgcggtacgggtggacaacatcaccaaggaagtcgtcgtcaagtgggcggctttcactgaagtcgtggacgaggaaaccctcgtacccaacggcgacttcgaggcaggcgacgatggcacgtgggttccgggcggtggatcgaacggcgaaggctggtcgattggcactggctcggactacgataccgacagcggcgtatacagcgcgcgcttcgccaacatcaagacgggcggcagcgacttgctcaacccgctgatccccgccaaggtcaacgactacatccgatgcacagccgaagtccagcagggcgcaagctccaagggcaaggcaggtgcgcgggtgtcgatcatctaccgcaaggaagatgggaccgagctacaacgcaactggggcaacatggtttcctccggcagcaacggtgcgtggcaccagtccgttgccgagggcgctgcacccaaggacacgaagtacgtgcaggttgttctctcggcgttccgcagcaagcagaacaagccgctgtgggtggacactgttaagtggaaccacaagtacgtgctgggtcagaacgacgacagctcctacttcctgagcatcaaggtcacggatgggttgaaccgtgtggcctactggtccggtcgtatcgaggagcagggcatctacgttacgtcgaagctctacagcttctaccagttcgatgccgcgatgctgaccagcagctttgctgggtacagcaacatcgacatgctacctcctttggatactgcgtcgctgggttcctccttcgtaagctgggaactgcgcagctcgcgtcaggattacgccgccgaggagagcctttcgtacggtagctctttcgtttcgttcgacatccgatccattcgcaaggactacacacccgacccggagacggcgcgactgtcgagttccttccattccttcaccatgaagcagcaccctgttgtcaatcagccgctcgacgcgactgctcgactccggtccggcttcgtatcatggagcttctcatgatccacaatcacctcggcatcgccggtgtgttcactatcagcaagggcaagtccctcgacgctctggaagttgtcgccgactggcagagcaaccttatcaccgatggtggtatggacgcactgggtgactctggcagcggatacccgcgcagcatgtacgacctcattgcctacttggcagtgggtagtggtagcgcaacccctgcgttcaccgacactgctctcggcgcgcaggttgcacaggttggtcgtacgacttcggataacggcggcaccaccacggccccgtactacgcctactcccgctgccagtaccagttcccggcaggcaccgccactggcgtgctgtccgagctgggtgccaaagcgtacaacagcaataccggcgcttacatcctgtccactcgcgcgcttatcaaggactccgcaggtaacccgaccaccatcacggtgctgtcggatgaaatcctcgtggtcacctacgagctgcgcatgtacgtggacaccacgcccgttgtcactaccgagactatcaagggcgtgagcaccaccgttacctgcaagcccatctccatgggccgtagcggcggcctgaacggccagtcggcagttgtgtggtcggactacgtgtggggctgctactacttcaccggcggcacgggcgatggaactggtgctatcactgaccagtatcctccgggtaacaacgtaagatactcggacttgcagattcagcgggtagagtacattccgggtacctactaccgggattgcgtttgccgcatgtcgatcaacaacgtccccggtagcccgatcacggctgcgatgggcctgtcctcgtgcgttgctttccaagttggattcaatccgggtatcaccaagaccggatcggaaacgtccaacctgcgaatgcgcgtttcgtggagtcgatacacgccatgatcccctctgtctcccaaagcatccaacgtggtgactgggtggagcagcagaaccggcgcacccgcccgctcattgacttcgagcagggcgggctggccctcaacgcggcagtggacaacctccaagccgcgctgtggactgccgaaagtgacggcagcagcgtcgtcgtttaccgcgacggcgttgccccggtcacggtgctgaccgactccgggatcacgcagatcgcactggcattcgaccagaccatgcgcccgcacgtggcgtacatgtcaggcggtgtgtgcaagttctactggtacgacacggtggctgcttcgatgcaaaccatggtgatccccggtgcgaccacaccacgcctgtgcatggacgagaagcgggcgatcttcgccacgcagagcgatgtgcttctgtcgtacaagaacggcagcaacctgtgcgtccgcgcgcagcgtgagcgcttcgcaaccgaacacgtgatcgcctcgggaatccccggcgacctgatcgcggtgggcatgaacaacgtcaaccgcctgcaatggaagctcgtcggcaatcccgacgactggccttaacctacaggagaacagcatgaccccgccgagtgtggtcaatgaggtcgtccgaacctcgccgcttacgctcggcgcggtctacctcaacttcatcagcacgtacggtgctgccatcgtaactacgctcgccattttgtacgccgtcgctcagttctactggcgcgcgcgcgagcaccgcaagatcatgggagggaaggatgtcgaaccccgcaagtgaaggcgcgcttggtgcgctacacgaactcgtcgccacggtactgaaggaacgcctcgccaacggcgagctgtgcaccgctgccgacatcaatgccgcgatcaagttcctgaaggacaacaacatcacggcgacgcgtgaggccaacaaggcgctcggcgaactggaagacgaactcggcaagcactcgctgccgcaggccgacgactccgagcttcaagcagcgctcgacaacatcgtgaactttccggggagcgtagccaaccatgcgtgaatcagccgaagcggcagacatccgtcgccgcaagttggagctgttgcagaaccactaccgccacttcgccaccttcatgcgcgacatcatgaaggtgctggggttcgagccgacgtggatgcagtacgacatcgccaactacatgcagtacggcccgcacctcgcaatggtgcaggcgcagcgaggcgaggcgaagtccaccatcgccgcgatctacgccgtcttctgcttgatccacgatcccactcaccgtgtgctgatcgtatcggcaggcggcacgcaggcatccgagattgctacgctgattcagcgcatcatcctcacggtgccgactttggagtgcatccgcccggacaagaacgcgggcgaccgcacctccgtggatgcgttcgacgtgcaccactcgctgaagggcatcgacaagtccccgagcgtggcgtgtatcggcgtcaccggcaacctgccgggtaagcgcgcagacctgctgatcgcggacgacgtggagtccaacaagaacagccgcactgccgcgaaccgcgagctgctgctgaccatcacgttggagttctcggccatctgcaccggcaagcccggtactcccggccgcatcctgtacctcgggacgccgcagaccggcgactccatctacaacaccctgcccggacgtggctacgacgttcgcatctggcccggtcgttaccctaccccggcacagcgcgagcactacggcccgcatctggcaccgtctatcgtgcagcgcctcgaagctgacccgatgttggcgtttggtggtggtccgatgggcgacgagggccagtgcaccgacgagctgttggccggtgagcagaagcaccagtccgaactgcgtcagcgtgggccgtccagctaccagctgaactacatgctcaacacgcggctgatggatgcgctccgcttcccgctgaagaccgagaacctgatcgtgatccccggtggtggcgaccgcttcccgctgacgatcacccgtggcctgagcaacgcgcaccagcgcagcttccagtccagcgggtacggcttcgtcatgatgatgccgcacgacatgagcaccgagactgccccagtgcagggcgtgcacatgcagatcgacccggccggtggtggtgccaacggagacgagacggcgttcgccgtgaccgccttcctcaactccaccgtgtacgtgttggccgtgggcgctgttcccggtggctacgacggtgacggcctgctcgaactccgccgcatcgcggtgaagtacaagccgaacgtcatcagcatcgaaaagaacatgggctacggcgcgttcgccaaggtgttcctgcctgtgctgcgagaagatcgcggtaccgagaagggatacaagggcgacatccgcgaggagttcgtgaccggcaacaaggaagcccgcatcatcggcacgctcgaacctgtcatggctcgcggctcgctggtcatgctggaatccgtggttgaaatggatcacgagtacactcagcgctacgcatccagcggaaagcgtcaggtctacagcctgttccaccagatggcgaagatcacgcagcagaagggcagcatcgcacacgatgaccgcctcgatgcactggaaggaagcgtgcgccactgggttgcgcagcttgcactggaccagaacaaggccattgccaagcagcagcagcgagagttccaagactggatcaacgatccgaccggcatgaaggcagcgacccgcaagagtccgctgcaacgtggccgtccatccctactcgaccgttaccggaggtaaccaatgcagaagtccgacttcaccagcaactacacgggcctgttcggccgtggcaactacctgcaccgcgaactgctcgccctcgtggagcatgcggagcagcatcccgcaaccgcagcgcagctgctcgcccagttccagaaggacgcgaccctcgtgctcgacgccctgatcgctgccggtgcgcgcacgcagtcctcgggtccgaactccggcccgcacactccggtcgatctggacccggacgatgacccgctgaccccgtaaggagcaaccatgaaccagcagcagaaccaagataccagcaacaaggggctgttcggcctgatcggcggcatcttcatcggcatttcggcaacgctgctgtcattcacccaaggccacgaaggggtacgctacgctgcgtacctcgacaccggccgggtgccgaccatctgctacggccacaccaagggcgtagcgatgggcatgacggcaacgaaggcacagtgcgacaagtggctggtcgaagacctacagatcgcccagaagggcgtgcgtaagcacctgaaggttcccgttaaccgcaaccagatcgacgcctacacggacttcgtgttcaacgtgggcgagaaggcgttcgctgatagcaccatgctgcgcaaggcgaacgcaggggatcgtgaaggtagctgcaaggagttcctgcgctgggtctacgtcggtaagctcgactgccgactgtccagcagccgctgctccggcattcccaagcgccgcgacgcagagtttgccctctgcctgcgccccaacaacgaggtgatccaaccgtggaaaccccaagtgaagtgatcgcacgactcggcggcaaggctatcggcctgctgctggtcgtgaccatgttcgtgtgcttcggtctgtacgtctacggcctgcaacgcaaggtggagaagctggaaactgcccaagtcggcacgaccgctaccgccaaggctgcgcagactcaggctaccgggtacgcaacctacatcaaagagaaggaggatgtgcgtgttcgcaccgaagaagctctcgacgccgttcccgagtatcgtgacggcactgttcctgctgatgtcgctgacctcctgcgcgaacctgccggttcccagcgatgatctactgaaggactgtcacatcacctacctcggtggtgagcgcggcacgtcttccagtcaggacaaggtggtcaagctcgcgcaggaccgccgcatggacaccgttctgtgcaacaaggacaaggccgcgctgcgtgcgtggaaggaagaagtgtgcggtaccggaaagcgccggtgtacgggggacaagtgaccaccatcgcgtgggacgggaagcacctgtgggcggacagtcaggccacacagggcgaccacaagcacaccgtccgcaaaatcctccctgtctcgacacccaccggccctgtgctgctgggtgtcaccggggacttcacagtgcttcgcccggttctcgctgcgcttaaagcgggcgaagggtacgaggagcacgttggcaagtccgccacggtccttgtggttaaggacggcgtactcacggtcactactggtaagcagcagtgggttgaggaggctccgtacttcgatggcagcggcaaggcgctagctctaggggcctatcatgcgagcaagtctgtggctaaggccatggctgccgcgatagctcacgatgtgtatagctccgggcctatcatcaagctaaaggcaccagttcgcaaggcttagtcataaggccacgtggatagccggaccaaaatttgcttcggaaatgcgcgggggtcactccaatagaagctcccgcgcgtgcccccgtacgccctcgcgttacgcgcctgcgggtgcgcccgcctgcgtgctcgcgtgtgcgcctgtgtgcgcgtctgtgcgcccgcgtcaaggttccgcgtgggtgtgtgcctgtgcctgcctgcgcgtggcgtgtgggcgcgcgtgtgcggccgtgcgtgcgcttgcgtgggcgggtgcgcctgctgcctgtatggctggaccgtgctgccgtagctgaatggttaataaatcttccgcgattggtgcttgacggcaggtcgggagtgtggtttcatagcgtcactggggcagcgacagggcctcaggagggccgcaaggggcttgacaggtgcatacctacctgctaccatgcgaaccgcagctgtaggcgtgtgagggccatctgtatcgtttcggccttttggtacacctatagcacacagtcggctcaacctgaatcaccgtctatcggtactctgtcgagctgataagttagctacccgctaggccaacggttgacacacggccgcaatggtagtaagctgcaacgcaagtcgagtgacgtgatccgtagtggcgccgccaacaagtgggctaagggtacatgggagtcactggttagggatgcgaggagctaccgaaccacgcttgacactgagctagcagtgagctatgatagg

SEQ ID NO: 21 - DNA, 43940 bp, Unknown
  Bacteriophage Xfas303
gatgatggctccacgttggaagcacgggccgcacattggatgcaggccacggggccaccagcgggcctacagggcgcacgcagggcttgacaggggcaaccctaccgggctatgatgcggacgcactgagggacgggagggcggcatctgtatcgttttccttttggtacacatacgacagagggcatgtcctgaaaatcgtatcggtctttagccggaagtgaaccaaggggttgacagatagcctagctatagactagcatcctccctgcggtcgccgatgcaagccacacggcaagcattgacagccaagagggttgacagacggttagcatagtggtaagctagtggtcagtcgagtaacaagctatgagcaagccgctgggacgccttcgggcagacgacaagggcaagcggccttagctactggtaggattatgcgaggagctaccctaccgggcttgacaggaagccaagagtaagctactatgcaccaacggtcaggaagcctaaaggcggagcgactactagcggactaccggcttacatggtaggatggtggcgacaggacgcccagtcgagacaatagggcttgacaagatgcaaacggtgcgctaccataggcaccaaggctgaaggatcagctaagactaccgctaacgggtagggtgtaacgggaagcctgcgacggagctaatgggatagctctaggtggaccgccaagctgcaacgtagcactagcggataaccggatgaactgggatgtcaaaggcccatagaatccaccagacttgcaacactggtgccgctatacctactgctaacgggtagggtttcccatctgccgtgagagtcggccacgggaagcaacctgtcggaatacaggaagccggtcatagctcggggcagttccgggcaccctcactggagggatacgtgcaagcctacgggacacggtgactatggcactgtatgcccggagtaaggttgacaacccgaaggggcatacagattgaagcggcttcacggttcgatggatagcggtagctccgcaccagtgtgcgcccacgataggcgttgttccgttgactactgcaaggcttacaggagggattgcagcccggcctgtagaagccgcttcaatctgtatgttttcgctttctcacagtgccaatggaggcaccactatgcacggcaacgctaacctcgaacgcacccgcaccaagcgccgcttttgccagttcacccggactgcaagcgtgatggacctgcggacgacggagtatgaccgcaagctcgcccagcgcaagcgcgacgcagaacgctacgaggcacgccacggaaccgccggaaagcgatctgtgtttgtcgctgggaatagcggcacggcaagggcgaatcatgcggcggatcgccgagcctacctgtaacaggacgtatgacgatgcgccttcccttgcggagggcgtatctgcgtgcgactggcacgataaccgagtggaccagaccatgaacatcgagaccaatgcggccaacatccgcaagagcatcaaggccatcaatacggcgcgcaccaagctggtggacacgatccagcagaccgccatcgccgtcatcaaccatgcccacgtccacggcgacgtgactctggcgtccgacctgtgccttgccgtgggcaacggcatgaagcacgaggcgctgcgcctgtacctgtccgagttcggcccgatggctccgaacgacgacaaggagaccaaggccgccatgccgatgaagtacgccaagagcaagcggctggagggcgaggagctggccgccatgctggagcgcgccgccgccaagatgtggcacgacttcaagaccgagaagcccgccgaggagttcagcttcgctgcggacctgcacaagctgctgggccgtctggagaaggccgtcgagggcggctatactccgtccgaggaggagcgcgccgtgatcgaagccgcgcacaaggtgccgaagcccgccgccaagcgcaagagcgccgaggtgaaggcatgagccgcctcacgggaatctacggggagcgcgttgttgcgctcctcctcgctgcggccatcgccgcccgtgcggacatcgacgacgagaactcgcttggcgaagccctgtgcgagaagctcgccgaccagatgcaagacatccgctatcgtgacgactacacccaagacgaggtgggcgctgccgtggacctccgcacgcagctctaccgggagtggccggagtggagcgggtgcagcacgtacccggtcccggcgtcgggcgaagatgacgacatgatcgacgagtaccgttccgacaacgaaatggacacggtggactgggacgatcccgatgcagccgctgccgcctacttcgacgcggtggacgagtgcgccctgtacaacggcaacatgtacgacgaggacagcgagtatggccggagccgtcgccgcctgctgaccttcctgatcgacgaactgaccaaggagagcgtgaacgcatgactaccatgaagaccaatgacggcagccagtacgtgctggtgctgaccaaggaacaggccgagctgctgggcacgttccgcttcagccacgtcggcggcagctcgccgctgtatgcggtgctgcgtgatctgccgcacaagatgggcgcacggttccgcaccgaggtggagactttcaacggcaagccgatcttccacgagctgatcccggcaggcgtggccggtgtgcgccgtggcgagctgctgacccagccgatggcccgcccgagtggcggcaaatccatgctggacgccgacctcggcctgctggaggtgctggtgctcgccagtctgatgaagggcgcacccattccgccgccgcgcaccgtgaccgggcgcatgcgcctctcggacatcccgatgccggacaacctgccgcgccgaccgctgcccgacgtgctgatggacgaccagactgcacgccgtgtggccctgacgccggaagcccagccgaagaagtggatcgtgcagtacctcgaacacgggaatagctgggtgagctgcgttggcaatgggcagatcgccaactcgacgtacacctcccgcaacgaggcgtatcgccagatgcgtgcgaggatcaagcgctacgggaccaatccgaacagctaccgtgtcgtgccgagcaccacgccgggcggcccggagcgtgaccgtggctactacgtggtggaatacttccgcaaggtgaaccgcccgctcggctggggccgcagcgaaagccactggctgcgcgacacgttcccgtccgccgagggcgcacgcctcgccatcaacacccacgttcccatcgctgaccgccaccgctaccgcgtgaagtggcacccgaaccgcacgtgatctaccgctgcgccttccaacgagggcgcagctttggaatcacgcccaacaaggagggcacattgcatgatccccgtcatcttcaagcgccgacataacggcaagcgttcgccgatgcaactggctgcgcagccacgccagtggaaagagttcgtgacctacgagcacagcgtagagcgctggtatgcgtaaggtcagcctgcgttaccgcgtccacatgacgagcctgaagacaggcgcgcagtggtacagcggtcagcacctcggcgcacccaatggatggacgttcgaggatcgagaagaggccgaggcatgggcggcgctggtcaagacaaacgaccgcatcgctgatgtcgaggagtacgaaatcccacccgtcaatgaggagaatcaaccatgagcaagacctacttcggcatcacccgtgccaagggcaccaacaccatcgtcggcgtcgtcgccaacccgaacctgaccggtgcccgcccggccaccaccgaggaagtgcaggaaatcctgtccaccatcaagcctggcgcgaccgatagcctgtcggatgcactgcgtgacggcacctacccgaaaaccgtggtggtctgggacaagcgcgccgccgcccgtgctgccatcggcgagctggaatccttcgagtccccgcacttcgactacggcgtcggcgagttcggcgacaaggtgcgcagcgtgcagcccgtgctgggttggcgcatcaagtacgacggcgactacatcagctgctacaactccgtcgaggacggcgcgaccgtccgcatcgacggcgacgaggagaacaacgacgagagcaacctgctgttcccgacccgtgccgccgcccgcgaagtgctggacaccctcggcgacaagcgcagcaagggcaacccgtcgggctacttcatcgaagcggtctacgccgatgcgtaagctcggcctgcgcctcctgatcctgctctactgggtcgtcgggcgtggtccgtggatcgtcgtcggccagtaccatgacgatgacggtaggctgtgccggttccgcaccggcgaggcaactcccgatgggttgtgggtccgcacctacgacaacctcgacgaggccaacgactactgcacgctgcgcaacgagcaggcaatgaccgacccgctcggcaccacgtactacgtgtggcatgagctggagttcaaccacttccacaacaaggagaaacgctgatgggtttcctcgacaagatcaagagcgccgccaagtacatcaaggacaaggtggtcaacgccatcaagccgcagcacgatgacgacaacacgccgcctcctgcgccggacacctcccgctacctgcacgtctcggtgccgctgattcccatcgagaacccgctgctgcgcaagatgctgggccgggactacatgtgcgggccgggccagacccgcaacgtgggcaacaacgcgatgaaggcagcggccgatgcgatgggcgcgaacaacaaggaacgccgccgcctccgcaccaagatcaagcgccgggcagccgagctgcgtgccggtgcatcgttgcagccgaacgtgcaggccgcactggcaggtgcagcatgagcctgcgcatgggaagctgggtcgaggtgaccgtgcctgacagccgactgctcaacgtgcagccggagattgccgccgccgtcaagctgatcggcggtgcgacgatgaccaatgcccgtggcctgtacgtccgcaaggataccggcgcactggatgacgaggcggtgaccgtgatccgcttcgacatgaacttgcagagcgagctggtggaccagtacatgggcgccatccgcgccatcgtggaccgcctgctggtgctcggcgaggagagcgtgctgcgtcgtcgcttctacaatggcggcggcgggtacaacagcgagctgatcttccagtaaatctcgcactgattgcgtgccggaagggaccacgttacggaccacccatcaacccgtcaatgaaaggagatacaccacatgtcgaacgataccaacaccgcccagcagacccagttctcgcacgccgaagtcaagctgaacgagctgcgcgaagaccgggccaaggcgctggagaaggtgagcaagatcgacgagaagatcgccgccatcgaagcgagcatcgccaacgaggccgccatcgaagcgctgaaggcaggcgacgccgtggcctacgtctacggtcgtgccttgaacaagcgcgtcctgtccggcaccgtgtcggccaccaagaagaacgagaagggtgtcgtgcagctgaaggtcgagcacggcgagggcttcgacgccgagttccacctgatcgacgccaccgccctgctgttcaccagcgaggacatcgagaaggcgcaggccgacatcgacgcagccaaggcggcggccgcagcgggcggcgaaggcggtgccgaatgaacgcttccgccccgagcaccgcacccagccgcacggcgttcgtcgccgggcgtgacctgaaggtcggctacaactaccgctgcatcgccaccggtgatggcaccgtggtggacggcgacacctacttgctcgtcaccaacgtcaacgacaagaagggcaaccgtcagctggtcaacaccagcaacggcgaggtcgccttcgcaactccgggttcgatctggagccactgacctagcgaggacaagatgagcaacgaactacctgacagcgactggctgccgcatgcggaacgactgaaggtcggcacccgcactcggatcaaccatgcgtgtggtgagggaaactcgttgctcatcactcgctcgcacgacaagtccaccgcatactgtttcaggtgcggtggcacaggattcaagcgtgagcacgagagcttagaagccaagctagtacgaacccatgccgagcaaaccagcgagcgcagagtgcgcgcaactgttgagttgccagagccacgtgtctatgacacaaccgagtggccgctgcgtgacaaggtgtggttctacaagatgggcctctcgcttcgcatgatcggggaactcggcctgtactggtgcccggacatcgggcgcgtggtactacccatcatggaaggcgaccgccctgtgtactggacagcccggtcctctacgaggcaaccgaagtggctgactcctgatgtcccgaaagacggactcgtcgcacgcttcggcgtgggcaagggagacaccatcgttctatgcgaagacccgctctccgcatacaaggtgggactggtaacagaagcgtggtcgttgctcggcaccaagctgcacaacaaggtgttgatgcagctgattgagcgaggccaacgtgtagcgacgtggctcgacgacgacaagggcagatcggacgggagcaatcccggtcaggatgccgcaaagcaaattgccgcgcgcctccgtgcgttcggcttggactatcggaacatcacgtcaccacgtgacccgaagtattatccgaccgactacattgaggagaagctatgtcattagacttgacactgctgcgattgtgcagcgacaagggcaagttcgaccggctggtcccgaacgctccgcgcgaagggctggacgagctgaccgtgctgatgctggatgcactgcgcgcgtactacaaggagttccccgagaccaaggctctgccgcacgacgtgttcgatggttgggcgatggagttcaagttcaagcagctgccggacgacaagaagtccctgctgaagttgcagctgcgtgcgatgcgcgagtctgtcccgcccgaggcggagcagggcatgatcgaaaagctgctggagctggagcttgccacgtccgccgtcagcaagatcgtgcagtggaatggcggcgctgagttctctctgcgtgacgagctgtccgctctggccgagggcatcaccgaacgcatggaccgcaaggcccggctgcctctggtgcaggagacgcccgaggagctgatggcgatggacgagggcgacatcggaatccacttccgactgcccagcctgagccgcaacctgcgcccgatgcgcggcggcgacttcggcatctacgccatgcgccccgatgcaggcaagaccactttcctgaccagcgagtccacgttctggctcccgcagctggacacggtgtggcctgaccagaagcgcaccggaatctggctcaacaacgaggggccgggcaagcgaatcaagcagcgctggtatcagtccctgctcaacgcaacgatccccgaaatggtggagtgggcgaaggacggcagcatccgcaagcggatcgaggaagcgatgggtggcgacatccaccgcatgcagttctacgacatccacggcttcacctcaggcgaggtcgaggcgatcatcaagcagaccaaccccggcttcatcatcttcgacatgatcgacaacatcaccttcaccggcggcatgaccaacggcgggcagcgtaccgatcagatgctcgaagccatgtaccaagccgcgcgcaactggtgtgtgaagtacgacgccgtgggcgtggcgacttcgcagatcagcgccgagggcgagggtgtccagttcccgccgcagtccgcactcaaggacagcaagacgggcaagcagggcgcgtgcgacttcatcatcatgggcggcaagctcaacgatcccgcaatggatcgcttccgctacatcggcacgccgaagaacaagctgcaccgcgcaggcggtaagcgtgatcctcgtgccgaggtgatgttcgacgcagagcgtgcccgcttctacgaggaggaagcatgaagattcgttggaacgaacagaagcgcctgtggtttgtggacctgccgaacggcgtgcgtgtctacacccaccgcagcgatcaggccgaggccatctacaaggcgagtgcagaagatgctcccgtcgcccgatggaagtggggatggctggtgaacaagggcagcatgtggatgggcgtgcattacagcaagcacaacctgcgctggtgcatcaacctgatcccgtgcgtcaccgtgtggatcaccaagccgggaggcaagacgccatgaaagcaggcgacaccgtagtgtgtcgaggctcgcgtggctacctgttcaccaccggcaaggagtacacggtgcagggctaccagcccgaggcgcacgacatcaacttcacatggcccgcatacgtgcaggtcatcgacgactgcggcaagaaggtctggtgccatgcgcaccgcttcgccgtgaaggaggaagcatgagttacgtgtccttcgacttggagaccacgatccgcgccacgctgaagcgcaaggcgaatccgttctacaacctcaaccgcatcgtcgccatcggccacaagcgcaagggcgacgccaagaacagcggccggtacttcaccaccgggcgtgacgaggacaacaactacgtcggcggtgcgccggatggttggctgaaggagctgtgctacggtgcgcagtacctcgtcggcttcaacatcaagttcgacatcctgcacgccatctgccaaggcccgcagaatcgcatggcatggatcgagttcatcgaccgtggcggcatggtgtgggactgccagcttgccgagtacctgctgcacggcatgacccaagagttccacatgtgcgcgatggacgaggtggccccgaggtacggcggcaacctgaaggacgacgcggtgaagtccctgtggaatgcaggggtggacacgtgcgacatcgacaagaccctgctgatggactacctcgtcggcaccaacgacaccgacgacgtgggcgacatcggcaacaccgagaagatgttcctcggacagctcgatgccttccgggcacgcaacggcctgcgctcggcgctgctcaacatgggcgcgctgtgcttcaccatcgaggccgagtacaacggcatgttcgtggacaagccgtgggcactggagcatgcgaagaagctggagcaggagcttgccgacgccaccgcagagctggagtcctacatccccgagctgcccgagggcttgaccttcaactggaacagccgcttccacaagagcgcgctgatcttcggcggccccatcaagtacgtggcgaaggttcccgtgctggttcccgaaaccggcaagcagcagtacgtccagaaggacgagctgcactacgtgttggtggacggcaccactcggagcatcggcgagtacaacgccaacgagctgcaagccttcgacggcatcgccgagaagttccccgacgtggcggtgttcgctggtggcaagaacaagggcgagcgcaagaccaagaaggtcaaggtcgatgacctgaccaagcccaagttccgcaacgaggacatggtgttcgtgttccccggatacaccgagggcagcgagcgctgggagagcaagtccgatccgggcgtgtactccaccgcagcggaagtgatcgaggagctgggcgctcgtgacatcccgttcctgaaggcgctcgccaagcgcgccgacatccacaaggacttgtccacgtacttcatcacgacggacgagaagaccggggagcagaagggaatgctcacgctggttgggccggacggtatcatccaccacaagctcaacatgaccaacaccgtgaccggccgcttgtcgtcgagcgacccgaacttgcagaacgtgagcaagggcgagtacgacgaggagaccggcaaggagaagggcagccagatcaagcgcgcgttcatcagccgccacgctggtggcaagatcatccagtcggacttcacgtcgctggaaatctacgtgcaggcgatcctcaccgagtgccgacagctgatcgaagacctgaaggccggtctcgacatgcacgttctgcgcgcagagcaggcatggggtgcggccgaaggcaaggactacgcctacatcctgaaggcagcgaaggacgagacccacccggagcacagcaagtggaagaagatgcgaggcaacgcgaaggtcttctccttccagcgtgcgtacggcgcaggcgttgcgaagatcgcagcgaccacgggcatgaccgaggaggaagtggagaagctggtgcgcgccgaggccgagcgttacccggagctgggcgagtacatcgaccacatgatggaggtcatcaaggccaaccgcgttacgactggccggttcgtgcagcacccggacgtgccgggcctgacctgtcagctgggccgctcgcacttcaccacgccggacgggaagatgtactccttcagcgagtccccgtctcccaagttcatcgcaaccaagcccgcctcacgtggcggcgtggcgcagtcgttctcgcccacggaaatcaagaactacccggtgcaggggactggcggcgagtgggccaaggcgagcatgtacgtctcgctgcgtgccttctaccgcatgtacgtcacccaaccggaacgctggctcggccaagccctgctggtgaatcaggtccacgatgcggtatacgtggacagcgcagcatccatcgccacggaagcggcagcgctcctgcatgcaagcatgctcgaagcctccgtctacatggagtggtggttcaagtggccgctacctctcggcgtgccatgcgaaaccaagatgggcgacaacatgatggaggagcacaaccctcccgaggagttcgccgtcttgttccccgagtaccgcatgcaaatccgcaaggacttcatcggtaatcacaacccgtcgtttgaataaggagaaaccaaagcatgagtctcgacaagctgctgaagcaggtgcaggaaaagggtcaggaccagtccgtggcgtccgccggtggcggcgactacaccccgcccgaagccgggcagaccggcgctcgcatcgtcgcctactacgaggtgggccaacacgagagcgagttcgagggcaagaagaagaccaacaacgaagtcatcatcgtgttcgagctgatcggcaagaagcatccgccgaaggaactggatggcggcgtcaagattccggtccgcctgagcctgcgcctcaacctctcgaccaaggagaaggccgcatacttcaagatgttctcccgcctgcgcaccgacgagaagcacttcgtccagctgctgggcaagccggtgctgctgaacgtggtccacgtggagcgcggcccggaaggcaagaagaagacgtacgccaacatcgacaaggaatccatccgcaagccgatcatccaagtccccgagctggaagacggtgagccgaccggcaacctgctggagcaggtgttcccggtgggcgcggcgctgaccgagctgaaggcgttcgtgtgggacttcgccgacgccgaaatgtgggacagcatctacatcgaaggcgagtacccggagcgcaaggacgagaagaccggcaaggtcatcgccgaggcgcgcagcaagaacaccatccagctggaaatcgccaaggcgctgaacttcaaggggctaccgtgctacgactacgcggcctccaagctggtcggcggcaccgtcaccaaggaaggcgtggatgcgctggacgcggcggtcggtgacgtggacaacgcgcagggcgacgaggacgacaagccgccgttcgacatggacgacccgatggcaggcgtcgcctgatggacctgagcgctctgatggctgcggctgcggagcgctccccgatgcccatcgtggaagtacgacagcacaaccgcaacgtgatcgctcacgtggacggggactacgctgcgtacttctgcgctggtagcgagaactgttcagcgggggatgcacgacgcaacgtgctctcccgcgtctcgcacctgaagcatatcagcggagcggatcgtgtcgtcatgcacctcacacatggcgcgtcatcgaagggtgacaggttcctcgctgctacgactcagccgtatcaggggcagcgccagtcaggacgcaagccgaacaactgggccttcctccgcgagtggatggagacgtacgacggcccgcacttcacaccgaaaatctggacgacccgcgaggcggacgacggcatggccttcgtcagcaccggagcagccaagcacggtaacgtgctgcatgtgatccacaccgccgacaaggacatgcgaatgttctgcggcacccacatcacgtgggaggactaccacatcgtggacgtgccgctcggcacctacgacatcgtgggtgcggacggcttgcagtatgggcacaagtggttctggatgcagatgctcatgggcgacacggcggacttcatccccggcctgccgagggttggcaaggccacggcggaagcgctgctgtccggcaccaagagcaacgccgaagccgcgccgctggtgtacggtaagtacgccgaggtgaagggtgacgggtggcagcggtacttcgccgagcaggcggtgctgctgtggatgcggacggaccgggacgccacgctgctggacgtgctccagctggacgtgttcggcgacaagctgaagcaggcgttctacgacctcgccgaggatgtcaacgagaagcgcgctgcgctggaggcattgaagcaatgaagcgactgacagcagctcaggtaaagctggtgcgggtcaagctcgcagcagaacagggcaaccgctgcgcactgtgcggcggtcagctcggactgaaggcaccgctcgacccggtgctggatcacgatcatcgtactggcgcagtgcgaggcgtactccatcgtgggtgcaactcgctgctgggcaaggtcgagaacaatggcccacgttatggagtgcgggacatcctcgccttctgcggagggcttgcgaactacctgcgaaagcacatgaccaacatcacgggctatctgcatcccacccacaagaccgaggacgagaagcgtatcgctcgcaatgcgaaagcgcgtaaggcccgagcaatgaagaaggagaacccgtgaacctcaccacattcctgaagcacgccccgaagcaggggccgaagattctgtgcctcgacatcgagaccttccccatcgagttttggggatggcagatgttcaacaacaacttcagcccgaagcagatcaagcgcgactggtccctcatgtcgttcgctgcggagtggctggacgacgatgatgccacgatctacgtggaccagcgccgcgagaaggacgtgttcaacgaccgcaagcaggccaaggttctccacgccctgctcaacgcggcggacttcgttctcgctcgcaacggcaagaagttcgacctgcgcaaggtgaaggctcgcctcgccatcctcggcttcccgccgctctccccggtcagcgtgatcgacccgatgctgctgaaccgcgacgagttcgcgttcacctcgcagaagctggagtacaccaccggcgtcatcgttcccgagctgcgcaagtacgaccatgcgaacttccccggcttcgacctgtgggtggcctgcatgcagaacctgcccggtgcatgggacgagtgcgaggcgtacaacatcatcgacgtgaagtccatgaaggccgagtaccgtaagctgcgtggctggtacagcaggcacccgaacatcgcggtgtactacaaggccgacggcagcgagcaccgctgcaacaagtgcgggcacaacgaaatgatcccgcagaaggcaccagcccgcactcaggtcggcacctacctgctgctgcaatgcacgcagtgcggcggccacagccgcggacggaagctgacgaccaacatcgagcagcgccgccacatcaccgttcccgcataaggagaagcgcatgagacttaccgatgttcgccgtggcgaccgcgttcgctataccggctccgctccgggcctcgtcggtaggtccggcgtggtgcatagcatctgcaacgagtacatcaatgtccgcttcgacggcttgatgaaggagtcctacgtcaaggcccagttcctcactcgcctgatgagcgtaggaggcatcaccaccacacatagggaggttcccttgcctgagcaactgaactaccgtaacgaagacgaacgcaccccgccgaccagcgaacgcggagcgggcctgaagttcgacggcggcaaagagcagccacggctgctgcaccaaggcatgccgctcgcactggccgaggtcgtccgcaccctcaccttcggcgctcgcaagtacgccgcccactcgtggcagcacgtcgagaatgggcaggagcgctatcaggatgcgagctaccggcacgacgcggcgcgctgccgtggcgagctgttcgatcccgagaccggcatccggcaccgggcgcaccacatcatcaacgagctgttcctgctggagctggagctgcgcgaggagaaggcccgtggcgcagagtaagaagcgctccatcaaggaggcgtgggtcaacatcgccatcgggtacagcatcaactactgcgcgaacatcgcgttgctgccgctgctgtggcatcccgagcacccgctgctgtcggcgcacgccatcggcgttgcgttcacgctcatcagcttcgtgcgccagtacatcatccgccgctggttcagcaagggtgactgatggcctgcgcccgctgcggccaagtgcatcggtacgtcccacatgaggccgagtgggcgcgcttcctagaggagcatcgtacccgcaagcatttcgataccgagtgggcgaactcactctggcatcgcacataccctgacgatgcgttctgcatactcgtgatgaagggtctcgcaggtttcgttccattcaacaaggagacacaatgaactacaagtccaacacccagcgtctgatccagtcctacgagggtgccgttgcttggggcaatggcggtcacgaggaagcgttgcaggatgcggtcaacaccgcgttccccggcctgaacgacgaaggcaaggccgagctgtacgctcgcatcgccgatgcgtgggaaggctaccgcaacggcatggtgccgcgcaagctgtggatcggtcagatcgtcacggacttcatgtccggccgcatcgccgcgaacgtcggcgggctgaccgtccgcaacaacctcccgaccaaggagaccaaggccgatgagtaagccctacatcgtacacaaggccgtcgagctggacaaggtgcagaagcgtctgcgccccagcgacgacgcgctgcgcaccgagtacctcgcacagcccaagtacgacggctgcaactgcgtggtggtcaaggccgccaacgccgccgagcacatcacgatcttcagccgcaccggcgaggaagtggtgtccgcgaaccacatcaaggaagcactggccgctgcgccgttcgctcccatcggagtgtacctcggcgaatactggcacccgaccatcgaccagccgaccgtgagcggcatgttccgcaagaaggacggcacgcagtacaccgaaccgttcttcgtggtcttcgacttcgtgagcatcggcgagtgggagcagggcttcagcccgctgacctacctcgaccgcgtgggccgcttgcccgcgacgctcagcaagatcgaggaatgcaaggctccgttcttccttgcggagtcgcaaggcttcctcgtggatcaggagctgtcgccgatggaagccgcccgcctgctgtgcgagagcggcccgtacgacgggctgatcctgcgcaagccgagcggcacgtggaccaagggcgacaagggaacgaagggtgaagtcatcaagatcaagcccaccctgacgctggacctgcgagtgctgcgcgtcaacatgagcaccggagagaagaccgggcgcgacgtgtggacggtggtcgtggacctcggcgaaggcaaggagcaggaagtcggtagcggcgtgccgcacagcgcggaccagctgccctgcatcggggacatcgtggaaatcgaatccatgtccctgagcaagtacggcctgctgcgcgagccgcgctacaagggaatccgacatgacaaggcggaggcggaccgatgagtagcaatgtccgcatcgacatcacccaccaagaactcacccgcagcatcgggatcagcatcaccatcccgttcgacgactacgcccagcagctgttcccgaacgagcacctgcgcgaggtcgtgaacgaggcgctggcgcgagtcctcgacgaagcacacaaccggaggtagcatgctcacccaagcggaactcgaactggagacctatgctttcggccaagagcgcatgcgcaaggccatcgagcgtaacgaggagaacggcggcgcgccgaacaacccttacgctcaggcggtgtatcgccggttcgtgcttccgcttgcggagcgtatccgggctgacatcgacaagccgcgcatcggcagggcgcaggcccacgtgccacttctgcgggcgaagtacgacccggagcggaaggacaagcgtgggaaggccatcaccgccgaagaacaagccaccgaatggtacgaggctatcgccttcgtggccgtacgtggttgcttggcggcttgcatcgccgagcagggcaagaaggataaggctgccggtcgtgaggtggtgaagcaggtgggcaccaacgtgtaccacgagtacctgctgacccagttcgccgacgcggagccgacgctgttctaccacctgatgaacgacatggaccgcaagctgagcgtcaacgagacgcaccgcatgaccgtgatgaagatgcagggcaggaagaacggcgtcgagttccacgagtggggccaagcacagcgcgatcaggtcggcggctacctcgtcgatcagcttgcgcagatgggcatggtggacaccggcgtgatgaacgaggtcgtggtgtccggtggccgccgcaagaccaagaccaatctgcacgtggagttgaccgaggacgtgcgcaagttgatccaccagatcagcgagttcgtcatcgagagcaccccgtacttcctgccgtgcgtcgagccgccgaaggactggacggacgtggacaacggcggattccataccaacgaaatgcgcaggctgcatccgtggatggtgaagacctacgctcagacccgcgacgactaccgtagcgccgagctgcgcaacgagatggctgcggtcaatgcgttgcagcgcgtgccgtggcggatcaaccgccgtatgctggaggctgtctccgcagtggcgcaggttcacgacatggaggaaatcatttcgcaggccgagctgcccaagccgcgcaagccggattggttggagaagggcatgaccaaggaggacatgtccgaatcccagcagcgcgagttcaagaagtggaagcgcgaggtggccgactggcacaccgacgagcgcctgcgcaacagcaagagcaatcgcttctacaacgccatgcgagtggcgcgcaagttcgtggactaccaagcaatctacttcgtctacttcgtggacttccgtggccgcaagtacgtacagaccaccggcgtctcgccgcaaggttcggacttgcagaaggcgctgctggagttcggcgagggcaagcccttgctcaccaagtcggcgaaggactggttctgcatcacaggagcaaaccgatggggatacgacaaggcgtctctgccggatcgtgtgaagtgggtggtcgagcatcacgaccagattctggcgtttgctgcggacccggtgaacaacgacgagtggaagaccgcagacaagccgctgcaatttctcgcttggtgcttggagtacgagcagtggcaggtattcggggatcgcttccagagccgcatcgcagtcggcatggatggttcctgcaatggacttcagaacttctccgcgatgctgcgcgacagtgcaggcgggaaggcgaccaacctgatcccggcaccgcttccgaatgacatctaccagatggtggcggacctcgtgaccaagatccttgaagccgaggaggacgacgaggaagggttccgcaggctgtggctggaccacggcctgacccgctcgctggtgaagcgctcggtgatgaccctgccctacggctcgcgccaatcgagctgggcggacttcatcgtgagcgactacctgaaggcgggcaagttccccgagctggacaagaagctgtacgacaaggccgcacgcttcctgagcaagcgcctgggcgtcgccatagctgacacggtagtggcggcagccgacgcaatggcgtggctccagaaggcgtccacggcgatcctgcgcgagggctacgaccgcatcaagtggatcacgccgtccggcttcccggtgacgcaggtgtactgggagaccgaggaacaccggatcaacaccaagctgtgcggcaacgcgaagctctccgtgcgccgcagcacggacgaggtgaagaagtcccggcaccgcaacggcatcgcccccaacttcgtacacagcctcgacgccagccacctgacgctggtggtcaaccgggccaaggccgaaggcatcgacgccttcgccatgatccacgacgactacggcacccacgccgccgacacagcccgcctgtacgaaatcatccgggaggtcttcgtggacatgtacgcccggcacgacgtgctggaggagttcagggcggcctacggcttcctccccgagccgcccccgatgggcgacctcgacctcacgcaagtcattgattctccgtacttcttcagctgaaggagtttcggtacacatacgacaaagggtgcctcgccctccggggcaggcatcaaacccttttggtacacatacgacagaggagacctcatgtccgaaaccaagatcatctaccgactggacccgaagcaactggctgccgtgcagcgacaggcgggttccgtcctctccgtcaattccaacaccacgcccttggaggcaggtgtgcagatcggaatggcacgagttctccgcattttgcaggagggattcaccgttgagtccagcaatccgaacaccaacgacgggtgatagagagcggatcagggtggcgctagacgctgccctgtatctgtctttagccccgagtgagagtgagcatagtagctcctcagtaagctacctctgtgacgatccacagtacactgtggaaatggtagtacagaatatggtagatgcagtagtgatagacgaaagctacctactggtattctctgtagtgaaaccttggtactctaagaacaggctagtcctgtctgaggacttggtactacggatcggtaaaggtagctccttcaaggcggtcgtcgccacactggagcatctggccgagaccaacgattgcgatgccatagtcacaggcggagcactagctcgatcctctcgggcaatcactcggctgtaccaacgcttcggcttcgagctggaggatggttcgccgcaactcaccaaacgaaggagatagcctatgggttccctcgtcggaggtggctcggcgaagaaggcagccctgaagcaagcggctgccatcgaccgtcagaccaaccttcagacccaacagaccaactaccagattcaggcaatggccgaccagatggctaccgccgccgcccagcaggctgcgagcgagtacgccgagaagttgctgagtgcgcccatcgaaaccgtggacgttacgctcggaacctccgaccttgacctgaagaccgacgacctgatcggtcgccgccgtacgacccggcagcagtaccagcgaatcgtcccgaccgcccaatcgcgtctgaccggaacctccggctcggacctcctgtgaggtgagcatggacaatccgatgcacccaaccactgcatgccagcgctacgagaagctggacgggaagcgcaacggtatcctgtaccggctggagcgctacgcttcgtggaccatcccgaagctgttccccaagaagaaccgcgatcaggacaccgaaccgctgacccacggcttccagtcgctgggcgcgcaggcggtgaaccacctcgccaacaagctgatgatgtccctgttcgccccgtcccggccgttcttccggctggaggcgaaccgcaaggcccgcgccacgatgagcgaggccggtgtggacccgaaggcaatccagacccagcttgcgaagctggagcaggaagcctcgctggagctggacaagcgctccatccgcgccagactgtacgacctgctgaagatgctgatcgtgctgggcaacgcgctcatggtgttcgacaaggacacggtgcgcgtgctgaacctccgcaactacgtcgtcaagcgcgaccgccaaggttcagtgtgcgaactcatcatccgcgagaagattcacaagtccgcgatcaagcccgcagcactcggcgcagtcatcggcaacccggagttcaagccggacgacgatggcaactgctgggagtacaagtgggtgaagttcaacggcaagaagtacgaggagacagtgtggctggacaacgtgcagctgcccgctaacttctcgtcgagctacactctggagaagctgccctaccgcgctgtgacgtgggacttggcggcaggcgacgactacggcaccggcctcgtggaagactacgagggcgacttccaagcgctgtccctcctgagcgaagcgaccatccaagcagcgatcctcgcctccgagttccggtggctggtgaaccctgctggtcagacttccgtcgaagacttcgtggcctcgcccaacggcgcggcaatccccggacagaagggcgacatcgagctgattagctccggcgtcgaaggcacgctacagaccaacctcaacatccagcagctctacatcaaccgcattggcgcaggcttcctgctccagacggcggtgactcgtcaggccgagcgcgtgacggcggaagaaatccgcatggtggccgaggagctggaaggtggactgggtggcggctacagccgcatcgccgtagacgtgcaggttcccgtggcctactgggtcatggagctgatcgacaagagcatcgccggttccgacatcgaacccgtcatcatcactggcctcgccgcgctctcgcgcaccggggaccgtgaccgactgctgggcttcggtcaggacatcagcggcgtgctgagtctgcctccgcagattctcgaccgcctgaagctgtccgcgtggatcgctgaccttgccgcagcgcgcggccttgatcccgcaacctacgttctgagcgaggaggagttcgggcagatgatgcagatgcgacagcagcagcagctcgccatgcagaacgcctcgcagcagatcgacaaccagaacaacatggagacccaatgagtcagaacgcacctccgggcggtggccccaacgcaaacgtgatcgtctcgaccgcgcagcccaacggcaaccagccgcctgccgccgacgatccgatcaaggtccagccgaaccagcccgccgcaccggcgcagccgcaggctcccgcagccccggcagcggccgacccgaacgcgctgaacctcgaacccgctccgcaaccgcaagccccggcaccgagcgcgccgcaggctccggctcctgccgagctgccggactacggcgacaacggcctgaacatcgcggccgactacttcgtcaacacgctgggtctcgacatcaacagtcgtgagctgaccgaagcggcgaagggcaacttccacctgctggaagccaagatcgaagtgctgggcgacaaggccaagggcgcaggcccgatcctcgcattggcgaaggactcggtgtcccgcatcgctgctgccgccgacgcgaagcacaaggaaaccgtcaccaaggtccacgaggccgtgggtggtgaggcgaactggaaggccgtgcagcagtacgcacgcaccaacctgcccgccgatcagctgaagcaggccagtgaggcattgtcctcgggcggcttggctgccgttgcgatggcccggcatctgctgagcctcgcgtcctcgaacccgaacgtctccgtgcagggacagcccgctaccaatccggctgccgtgtccgagtcgttgcagggcgtcgccccgctcacccgcgagcagtaccgtgcagagtaccgcaagctggtggacaagctgggcatcagcggtgcagcgaagtccgacgagctgaaggctctgaacgctcgcgtcatccactaaccaacctaggagcatcactacaacatgagcaccatcttcccgaccgttccggtcctcccgaaccagatcaaccagcagggcaacgagaacgccctgattctggagcagttcaccggcgacgtggagcacaccttcgtttccagctccgtgctggagaagttcttcccgcgcaagccggtcaagggcaccaacaccctgaccaagaaggccatcggccgcaccaagctccagaagctgaagcgcggcgacgcgccggacggcacgcaggtggacttcagcaaggcgtccgtgaccgtggacaccatgctgctgtcgcgccactccatctggcagctggacgacatcttcaccgacatcgacacccgcaaggaaatcgctgtcgagcagggtcaggagattgccgagttcgtggacgccaccatcagcatcgctgctgccaaggctgccgccatgaccacctcggccttcaccaagaacggccgcgcgcccgagggccacttcggtgccacgcaggtcgtgctcgccgctgccggtgacgagaacgatccggccaagctgtacgctgccattggcaagctgttctccgaaatggaggagaccaagaaggtcaagccgcagcgcgatggcatcgtcctgatcgtccgcccgaccgtgttctacaccctccagcaggccgagcagatcgtcaacggcgagtacctgaccagcgacggcaaccggctgaccggcatcccggtcttcaaggcgtggggcgtcccggtcctgtcgagcgagaacctgccgaacggcgtggtcgaaggccacctgctgtcgaacgaggacaacgacaacttctacgacggcgacttcaccggcctcgtggccgtggcggtctcgccgcgtgcgctgctgatcgccgaagcgctgccgctccagtcgagcgtgtggtggtccgacgcctcgaagtgcttcttcgtggacagctggatgtcgttcgccgtcggcttcaaccgcgtcgaactggccggtcgcatcgacgcggctgcctaatccatccgggcgcagtccctgaatccctcgggtaactcaaactgcgccctctaccaaggagtaagacacaatggtctatgaccgccccttcgagatttccaaccgcgtttcgatcaccgccgccatcgcgtcgctgggcatcgaggccggtacgctgggcaccgtcgtcgccgtcttcggccgcgatgatgcgtggcgtatcgtcgtgcgcgtgaaggatgacgagaacggctcgcaggacttcgagctggccccgtccgccgtgaccctcgcggccgactgatccaccggcagggagagcacagcgctctctctgccttgttccctaggaggcatcatgttcatcaccaagttggacgtagtgaacgcctgcctgaagacgatgggcgaaacgaagctcaacactctggaggaagatcacccgtacaaggatgatgccctcgacctcgtggaccgtgtgctgcgcgacacctcgtcgctcgcgctgtggttcaacgtggagtggttgaagctccagccgcaggccaccagcaagtacatcatggtcccgaccgatgtgctgaaggtggacccggtgccgcactgcggcgtgcggcgggtggcccagcgcggccgacgactgtacgatgtcgcacgcaacaagtacgagttcgatggccccgtcaccgtcaaggtggcccggctgctggacttcgaggactgcccctacgaggtgcagatgttcgtgcgcgacgacagcgtgctgcgcttccagtcggacttcgacggcgacaacaccaagtaccagaagattctgcaacagcgagagctaagctggatcaacctgaagtcggagcacatccggcagatcaaggcaaaccctctgtatgcgcgggcaagtgtggacgttctgcgtcagcgcgtgttcaattacagcgggcatccgtggcatagccacaccacattccccggctaaggaggcatcatggcaaaggcaggcggaacctacccggacatcgtgcagggcgtgagcggcaagccgccgcaccgccgccgaccgggacagacgaccgagcagatcaacattctgtccgatcccgtcgaagggcttgtgcgtcgtcgcggtacgcgcttcgctgcccggctgcctctggccctgagcgaggcagcgcgcgtcgagctgcaagacatggacgtgttcgacttcacgcaggagggccgcgagtacgcgctgctgtatcgccgcaaggcgtcggcgctcggctccgcgagcttcgcgttcctgtacgacaagacgggcgagcagttcatcccgatcacgtacgagaacagctcgtgggtcaacacattggtggcaggcggggcgtcgtcgctcgcagccatcggcagttacgtctacatcgcgggcaacgacaaccgtccgagtgcgaccagcaccaacctctggcaggaggagaccaacctgcaccggctcgccgcgtggattcgcaccggcaagttcaacaccacctacaccgtgaccttgcaccgagcagacggcaccacgttgcaggtgacgtacaagacggtgacggctgcctaccccggcacgctcgacacgagcgacatcccgttctacctgcccggcggcacggagccggacccggcgtaccagaagcacgtcaacgaccgagtgaacgagtacaactccgcagtcaacgagtggatcgtcacgagcgccgagcagacccggcccgagtacatcgccgagaagttgtcggacttgctcgttgacgagggcgtgtcctcgacctacctgaagggttccatcctcatcgacgatgaccagttcgtggacatcacggtggacgatgaaggcgacggcaccacgttcttcgcggcggggcaggaaatcaccgacgccacctacgcgaccaagtaccacttccacggcaagatcattcgtgtgcgcccgagcggcgcaggcgcggacgaggcgtactacctgcgcgctgagctggagagcggcgagacctcgggctacggctcggtggactggttcgagactgcgggcgtgacctgcaccatcgacaaccttgtcgcccagctctacatctacaacgggcaagcgtgcatcgctcgcaacggtgcaggcatcaccagcatcttcccggcgagcggggaccatcccgcatacggcgagcgcaaggtcggtgacggcctcacctctccgatcccgtggttcatcgacaagcccatcacgatgttgtctgtcttccaagaccggctgatcgtaggcagtgcgaactacgtcaatgcgagcatgagcggggactacctcgacttctggcgcggaagcgtcgtgaccatcgccgacgacgacccggtggaaatgttcgcgttcggttccgagggcgacgtgctgcggcatgcggtgctctacaacggcaacctcatcatcttcggtgagcggcagcagtacggcgtgagcggcgatgcgctgctgactccgaagtctccgctgatccgggcggtgagcgcaaacaaggacagcaccgacgcgaaggctcagacctccggcaacttcatcttctactcgcagtacggtagcgagggcgtgagcctgcaccagatgcgcgtgggtgccctcaacgggcagcagacagtgaccgacgagctgagcgaggagcaggacaactggctgacgggagaaccgttgcagatcgccacggtgacggcaccgaacgtggtgctgttccgcacccgcaatcagcccagcacgttctacctgtaccgctacgaggacaacaagaacaacgggcagcggcagctggaggcgtggagcaagttccagtacgcggcatcgctggggaacatcctcggcgtgagcgtgttcaagaagtcgggaatcgtgttcaccggccgcgcaagcggtgtggtggccgacgtgctggacttcaagggcgagctggacgagcacgggtacatcgactctcgcatcgcgtacgcgaaccgcacggagaacggtgtggccgatggctccgtcgtggtcaacgcgacgagcgactacttcctgctgggcacgccactggcgcgcatcacggagttcctgtcgcagttcgatgacctcgaccctgcggcgctggagttcggcgtggtgagtcccgcatcggtgactccgaccaatccgttcccgcgagaccagaacggacaggctgttctggacggccgcatggcactcaaccgcgtcaccgccgacgtgcagaacaccgcaggcatggtggccgtggtcgctacgcgcaaccgggtgcagagcagcatcgacttcgagggccgcatcctcggcgacagcgacaacttggtcgggcagcagccggtgtattccgggcagctgtcgatccccgtgggccgcgaggtccgcgagtgcagctacacgatcagctccaaggactggctcccgctccgagtgacgggcctgtcgtgggttggtcagactttcaacaacgtgcggagggttagctagtgggtagcgtaaacactatccttcaggccaacaacaccacgcgggttgcacgagcgaactggcgcgcagctgaggcaaagacgaagaacaccaacgccctcgaagtggcgaaggggaacttctcggagtacatgcgtacgctcaacaaccaagcgaaggtgaacgcggcctcgaaggagtacaacttccagatggagcagctgtcggaggagctgcgcgcgaagcaaggggcgggcctcaacacgcaggtccagctcgctgcggcgcgcggtgccctcgcggcgcagtccgggtttgtgggtgtcggtggttcgtccgccgacctcatggacacgatggtgcgcttgcagtccgaaatggatcaggagacgcagcagaacgcgatccagctcatgtcgagccgaggcgctgcgcagacggcgcagatcatggcgaacgcctacaagggtatggacatcagccggacgttcggccagttcgactatcaggagcacatcgagccgaagcgcatgaagcgccgcttgggcaagctgattggcgttgcagtcgcaacctacttcggcgggccgatggcaggcgaggccgtggccgacttcgcggttggcacgtggcaggccgagaacggtgacttccaaggcatgagcaagagcttcgactccggcatccagaatggcatgtcggcgtggcagcagacttcgcagcgcggcggtaagtcgtgggcgtccagcaccttcgggtacaacgacggcacgggccgacaggcatccaccggaacgggcgcgaagatcaccacgcagttcggcaacaactacgacaacttctccacgactacctccggcctcggctggttcggtagcgggagcaattcaggaggtgcatggtaatggctattggtgatccgggcacgatcaccttcagcaccgagacggtcggtggcggttcgcttggcgcgaccgctgccgttccgcaggccggtgtgcaaggtggtggcgtggccccgctacaggcggtacgcagcggcagtgactggttcgccggtactggcggcatgacgatgccggacagcaatctccccgagttcttgaacgagattactgccccgaaccgcaaggcgctggagcagcagcagatgtgggatggcttcgttgcggcgcgcagcgggcagacgatggacgaaatctctgccgagcagccgtggtacagcaagctgttcggtcccacgaactacgagattggcgcgcagaactacaacgtgctgcgttcggtctcggacatggagcaagacctgatccaccgcatgccggagctgcgcaagctgccgccggaagcgatggcacaagagttcaacaggctcgcccagtctcagatgacgggcaacggctacgcagacgccgtgttgcagaagaccttcatggaccgcgccggtccgctgatggacctgcacaccaaggagcgcgtggcgtggcagcagagcgagctggtcaaggcgcagtacgcgagcaacagcagcaactccaccagctacaacgaaatggcgaagcgcgtggcgctgctgggcaacaaggcacccggcgatgaagccgaggccgagaagctgatccagtcgcaggtgagcctgctggacggactgtcgccttccgcctaccagacggacgagagctacaaggcggcgatgaccgcgttcgttcgtggcgctgctgaccgtggcgagttctacacgctgaagttcctcagtcagcgtggcgtgctgtcggcgctggacccggacgatgccttgcagttgcaggcgtacgtcaagcagaagcaggcgcagtacaagtccgagtggctggacaacaacccgcaggctgcggagcagatggcgctcgtgtcgctgtacgctgccgagggcatcggtgctaagccgaccgaggcacagatcgaccagctcaacatgagctacgcggccgcgaccggcagcgacgatccgctgtactccggcacccagcgtctgagcatgatggcccagtccgcaggcgcgcacatccgcgcgcaggaagcggtgctgcgtgagcgtgcggctgctgccaaggcggcgaacaccgagcaggcgaagctggcggcgcagcaggaggacatccgggcggccatcgactcgtggcggcatggcacgtactcgcagacgatcaacgtgccgggcgtggacaaggagctgctggaggcgaacgtggtgcagggcttcaaccagaccttgcagacgaaccccgcagtggcgatgtcgcagctggtgtggaacgccaacactggacgcggcgctgtgctgaagggcgtggccgatcagtaccagaccacggcacgtgcggtcctgcgtgagcagccgaacgacgcggcgcgcgacctctacaaccagtggcgcatgctgaagaacacgactgccaagcgcatcgacatcaacggcaatcccgtcgagggtaggctgtccggtgcgaccaccgcagccctgtacttcggcgacggcgtgaacacgatgttcaacaagctgcaagcgctggaggaatccggcgtgaacttcgagctggcctacgaggtggcgcgtggggaaatcaccaccgcggacccgaccgagttcagtgcaagcagccgcaaggaatccgaggcgttgcaggcgcgcgttgctgacgtgttgcagaaggcgaaccccgcctacttcggctacttcggcaacaagctgggcgactccggccgggccgcagctgcgcgtgcaatcgtgcgtgcggtcaacgagtccggtggtctactcgacacgtcctccgaaggtatcactgctgcgctcaatctcgccaagctgaagtacggcggcgaggatgcgggcaagtattactgggagaacgggcgtgacgacgaaggtcacgtcatcggcagcgtcggcgcatggctgggcttcatggacaccaaggagaccgggcctgcaatcgaagcggtaatcgacgccaccctccgcgccaacaacgtggagccgagcaagagcctgaaggccgacgtgttccgcatgcgtgatagcgagaccggagagccggtgctgtacgtcaacacggttggcgagaggggctggaaggtcgtcgccgtcactggcgctgacatcaaggccgagtacgaacgccgccgcaaggctgcgacccgcaccgagttcccggtgccgcaaggctacgtccgcatgccggacggtagcatccagcagagcatttccatccaacccaaactctaaggagaattagacaatggcactcgatctttcggggctgacccaagaccagcagatcgctgcggctgccgcttacgcgggagtgccggagtcggttgtgcgtggacagtggcgcgtggaatccggcaacgggcgcgcacagaagaatgcacagggcatcatcacttccgaggcgggcgctcgcggtgacttccaagtcatgccgcagacgcaggccgtcatcgaagcgcgcacgggcaagaagtacgacgtgcgcaacttccaagacaacctcgaaatgtacgcgcacatcatgcgcgagaacatgcagcttgccaagggcgacgttacgaccgcactccgcatctaccacggcggcaccaaccgtgccaactggggaccgaagaatgcggcgtacgctccggctgtactgggcggcgaggctgccccggctgtggctccgcagggcgcggccagtcagggcggcatcagtgccgcttgggccggtgcaggaaacatgaccacgcagacgtggagcggggcgagcatccccgcagcatggcgtggggatgccatcgaaggcgcgggcagcggtctcgcccgtgcgacgaaggagtacatcggcaaggtgcgcgaagggctgggcgaactggcgatgggccagaacgtcatcgccggtggcaccgccgagcagggcgtggctgcggcgcaggccgtgcgcggtagcgacgaggtggtcccgtggtgggtgcgacaagaagtctctgccatcgacacgcagagcaacgagcgcaacactcgcgctgccatcgctgccacccagtccgaccgggacgaggttgcgttccgtgactcgctgtcgttcctcgacaagtggggcgcggcgttcgatagcggcatcggtgctgccttgaccaaccagctcagccgtgaccgcgaggtgacgccggaaggttggacgtacgacccgaagcagtgggagaagtcctactacaccgccgacgagctggaggacatccgcgatgcggcatactccccggacgaactgtcgtacgtgacggatcgcatctacatgcgccgccacagcatgcgcatcaaggagaaccagaccggctggggcagcttcggctacgacctcgtggcgggcctgaccgatccgggtaactgggcgactggcggcttggcctccggtggtgtgcgcgcgctgggcgtcggctctgcggctctgttcgctgaaggccgtgtggctgcgggcatcgcttcgagtgtcgccgagaacgccgccgcgtccgtcatcacggatgcagcactggtgggcatgggcgagaaccgcaccgtcgccgacttcatgaccgacgccgccttctcggctggtatcggcacggcgatgaacctgcgcggtatccgtagcgcggctgctgtccgcgacaaggccaccatcgacttggcctccggcaacgccgccatgtacggcgagcagtggaatgcggacctccgcgcacgcgccgtggctgaggtgggcgagggcaacccggtggcgctcaacgcgaagattcactccctcgcgcgagccgaggtgatggactggattcgtgcaggcatggctgacgtaccggacgacttccgcctgttcgctcgcccggacgtggcgcaggaagcctcggctgcctcgaacgctaccggcgcactggcgcgtgacgtggagaacgtggacccgagcaccggcaactacgccgacaacgtgggcgggcgcgtggagtggaacgctccggccgatccgctgctgacccgtgcgtggaaggcgagcggtatcaagggcacgcccgatgacattctgcgttacctcgaatcctcgaagaacgtgccggaagacttccgtgcaatcgccaacacgctgaagcgtagcggtcggttgaatggtgtccgcatcgctcctgacgccgagctggctcagtggttcccgaaccagccgaacgtggccggtgggtacaacccgtcgctcaacgcgatggcgatgcgtagctctgcgcacaacgccgaggtggtgctgcacgaaatgctacacgccgcaaccttccgctcgctgcggcaggatgcgaacttcaaggcgcagatggacgagctgctgacgcacgtcaatgccaacctgtccgaggcggaccgcaacctgatgactcaggcgatgcagggccgggtggatcagcagcgcatgggcttcctcgccaacaccgacgagctggtgtcgtatggtctgaccaaccgcgacgtgcaggcagtgctgcgcaacatcagcgctcctccgggcgcaacgcagcagaccgcgtgggaatggctgaaggacaagatcgcccgcgtactgggcctgaccggacaggagtctgcgttggagcgcctgatgaacgtggtcggtgagaacttgggtgaggagattcgctctccgcaggctgcctcgcagcagacccgtggcatgctggtcaactcgatcttcaagaacaaccgcgagcgcaaggctttcatgcagcgcaccgggctggacaagcagatcagcgacagcgccacccgaatccaagtcgccgaggtgatcggccgcgccgagcgcttcagtggcaagtatgccatcgacgcggagaagctgtccaccatcatgcagaagttcgggctggaggcgacgagcaccacgctcatgtcgtcgcagtccccggtcgctcgcatgatcgccgtcaccctgctggagaacccggaaggcgcggctggtcggcatagcaccgcagcgatggatcgccgcggtcgcttcgagtcgttcatgggttcgcgcccgcgtcagtgggaagcggcctaccggctgtggcgcgccgacgtgcgcaaggctggtgcgatcaaggacttcgccaccggctggaagatgcggagcgagttcgagtacgaggtgaagctgtaccgcgagaccatgtatatgggccgcgagattgccgacgcgcacgagtccatcaagcagatggcgaaggcgctggacgaaggctacaaccggatggctgccgagcagcgcgctgtcggtacggtgggttcttcccgccttcccgatggtgacgtggccggttacgagtcccgcacttggctgggcggcaagattgctgcggctgggcgcgtgcgccgtgagagcatccggcaggcactgcgtgaccagttcgatgtgatgggcgagctgtacggggacaagttcctcgacgacctgagcatcaagtatctggagcggatcgaggagcgggctgcgggcatgaaccgtgcgccggacaacctgttctccgataaccagtctgacactctgcgggacaccctgcgcgcactgtcgctcaacgaggaggaaatccagaaggtgatgggccgctactcgcgtggcggtgcgaagcacaccaagagccgtatcgacttggacgtgacgcgcaagtacaaggatgccgagggcgagttccgcctgatggactacttggacaaccgcgtgatggacaactaccgcaagtacgcgggtcgtgtggctggtgacatcgctctggcgaagcacggcatcatgggcgacgccggtatctcggtgctgcgcaaggccatgcaggttactggtgccaacgacgtggagctgcgtgcgttcgatcaggtgatgtccgagttcacgggccgtgttatcggcacgggcgatccgactgttctggcgaatgcgcggctgctgacctcggctatccagctgggcggagcgggcatcaaccaagcggcggaatactccaacggtctcccggctgtcggcgctgctggcgtggcggaagccatccgaatcgctcctcgcatgcgtgcggaaatcggcaagctgctgcgcggcgaagacccggagaacagcatcctcggcggcttcgagttcatcagcggacgcggcttcggccttgcgggttacgacctgcacatgttcaactcgatggacacgcaggcttcgctgtacggctccgagcgcgcaggcttcctgaccgctctggcccagcgcactgccaacgccaaccgcatcctctcgggacagcgcgcggtactggctgtgcagcagcgcggcttcgcggaggtgctgatcgccaagggtgtgaagttcctgcgggacggcaaggctgccgatactgccctgaaggacatgggcctcgacgacacgctgcttgctcgcctgcggcagacgcaggatcaggtggtgcgctggggcgcggacggtaagctggaggctgtggacccgcgtggtctggagaacctgcacgaccggcaggcgtggctcgcgttctacaacgccatcgaccgtggtacgaaccaaatcttgcaggacaccttcatcggtgagaccggcaagtgggcgcacaacggttggctgaagatgctgttccagcaccgcacgttctcgctggtcgcacagcagaagcagctgggtcgctacatgggcctgtacggcgcatggggtactgccggtatcatcgcttcggcgatggccgtggttgccccgctgcaagccctgcgtgtggcttcgcgtgctgtcctcctgccggaggagcagcgcgagcaggctatcgaggatgcactgtcgcctctggcgatgggccgcagcaccatgaactacatcagcgcaacggccttcctcggcgacgtgctggaagtggggacgggtgtggcgggtggctggtacgagcacgcaaccgacaccggctccccggactgggtgcggcagctcgcgggcggtcagctcggcaaccggaaggaaatcgtaggtggcagcttcgccccggcgctaggggtcatcaacgacttcgcgcagggcgtgagcgggcgtcccgagaaccttgccgacgtgctgccgggcggacgcctgccgtacgtgatcccgctgctgaagggcgcggcggcgcatctggaggaataacgctggcgggccaaggacggcccgacttttggtacacatacgacaaacacaggaggcagcatggcagttcccgatccccagctgcgctacgcgacggacgtattcgacgccaatggcgtcactaccgactggcaaatcagcttcacgggcggctacatcgacccgtcccacgtgtacgcgatgagcggcattctggacgaggaaacgcagctgcttaccgaccggacctctcacaccgtggaggtgctgtccgaggatgagaactcctcgaccgtgcgagttgagcctgccgtcgcggctgggcgcaagctctacatctaccgcagcactccggtgcagcagatgctcgttgactacgttaacggtagcatcatcagcaagaccaaccttaacctaagcaacgaccagttgctgaagatcattcaggaaatgttcgattcgttgaacatcgccacccttagcattgaccagcaagtcggcgtggtggtggacctgaacaagatcatcaccgagatttacaaggaagtcctcgaacttctggccgctggcggtatcgtgtccgtagcccctcgcgtctggtccggctcttggactggcgatcaggcggacgacaccgacttcgacatggtgggcgcggacgtatccggcgcgggcttctacgacgtgtacgtcaacggtatcggcatgcagccggacgtggactatcaggtcacgctcgctgacggaaccgatcccagcttcatccgcttcgccacggttcccgctgagggaagcatctggttcgccgtgctgcgcggttacgccaagccctacaccgggcctgcgccgatcaccgctacgagcctgcgggtgccgatcatcccggcagagggtccgacctactacgccgacaaggctaccgagtacggactcgtgcgctgcacgtacgccgggggctgcaccgtcaacatcaacctgatccccgaggtcggcgacggtgagacgaagctcgcctcggggagctacttcagcgtgcagcagaaggcaggcccggtggtcatcaccggcgacgcgggcgtaactctcgaagtaccagccggctgcatcgccgcaactcgcggcaccaactccgtcgtcactgcaacgtgcatcgacggcgacaccaacacatggttgctctcgggcgacttggctaaggagtaggcatggctaatcacttcaggctgtacggccgaccgctgatggcggacgaggttgcagatggcctgtcggtgacgggcgtgctggaagggtacacggcgggcgaggcttacgagtctcgcctgtccatcaacaacccagtcggccgctgcaccgtggaggtcatcgaatcgacgctccctccgggcgctgcggtacgagtggacaatatcaccaaggaagtcgtcgtcaagtgggcggctttcactgaagtcgtggacgaggaaaccctcgtgccaaacggcgacttcgaggcaggcgacgacggcacgtgggtgccgggcggcgggtcgaacggcgaaggctggtcgattggcaccggccaggactacgataccgacagcggcgtatacagcgcgcgcttcgccgacatcaagacgggtggcagcgacctgctgaacccgctgattcctgccaaggtcaacgactacatccgatgcaccgccgaggtccagcagggcgcaagctccaagggcaaggccggtgcgcgcgtgtcgctcatctaccgcaaggaggatgggaccgagctgcaacgcaactggggcaacatggtttcctccggcagcaacggcgcatggcaccagtctgtcgccgagggcgcagcgcccaaggacacgaagtacgtgcaggtggtcctgtccgcattccgcagcaagcagaacaagccgctgtgggtagacaccgttaagtggaaccacaagtacgtgctgggtcagaacgacgacagctcctacttcctgagcatcaaggtcacggacgggttgaaccgtgtggcctactggtccgggcgaatcgaggagcagggcatctacgttacgtcgaagctctacagcttctaccagttcgacgccgcgatgcttaccagcagtttcgctggttacagcaacatcgacatgctaccgcctgttgattccgccggtattggttcgtcgttcgtgggctgggaacttcgcagctctcggcaggactacacggccgatccagaatcggcgctgtacggaagctcgttcgtctcgttcgacatccggtccatccgtaaggactacacatcggacccggagacggctcgggtgtccagttccttccattctttcaccctgaagcagcaccccgtagtcaatcagccgctcgacgcgactgccttgattcggagcggcttcgtctcatggagcttcgcatgatccacaacaaagtgggagtagccggcctgttcactatcagcaagggcaagtctctcgactcgctcgaagtagtggcggactggcagaacaacctgattaccgataccggcatggacgcgtttggcgaccaaggcagcggctacgcgcagagactctacaacgtcatcagctaccttgcagttggtagcggaagcaccgagcctgcgttcactgacaccgcactcgctgcacaggtagcgcaggtgggccgcaccagttacgagactggcggcacgtccaccgctccgtactacgcctacgcacgagtgcagttccagttcccggcaggcactgccaccggcgtattgtcagagcttgggggtaagtggtacaacagcaacaacggcacttacccgcttacgactcgcgcgcttatcaaggactcctccggcaacccgaccaccatcacggtgctgtcggacgagattctcgtggtcacctacgagctgcggatgtatgtggacactacgccggtcgtcactaccgagacgattaagggcgtcagcaccactgtgacatgcaagcccatcgctctcgggcgcagtggctcgctcaacgagcagtctgctattgcgtggtcggattacgtgtggggctgctactacttctacggaggcaccggcgacggtactggcgcgatcacggatcagtaccctccgggtaacatgtccagctttagcgatctgcaaatccagtacgttgcctacgtgcccggcacgtactaccgcgatgtggtgtgccgtatgtcgatcaacaacgtaccacccggcccgatcactgcggctatgggccttagttcgtgcgtgccgttccaagtcggcttcaatccgggcgtcacgaagaccggatcggaaacggcgaacctgcgcatgcgcgtttcgtggagtcgctacacgccatgatccctactgtctcccaaagcatccaacgtggtgactgggtagagcagcagaaccggcgcacccgcccgctcatcgacttcgagcagggcgggctgactctcaacgcggcagtggacaacctccaagctgcgctgtggaccgccgagagtgatggcagcagcgtcgtcgtttaccgcgacggcgttgcccccgtcaccgtgctgaccgactcagggatcacgcagatcgcactggcctttgaccagaccatgcgcccgcacgtggcgtacatggcgggcggcgtgtgtaagttctactggtatgacacggtggctgcttcgatgcagactatggtgatccccggtgctaccaccccgcgcctgtgcatggacgagaagcgagcggtattcgccacgcagagcgacgtgctcctgtcgtacaagaacggcagcaacctgtgcgtacgcgcgcagcgtgagcgcttcgcaaccgaacacgtgatcgcctcgggaatccccggcgacctgatcgcggtaggcatgaacaacgtcaaccgcctgcaatggaagctcgtcggcaatcccgacgactggccctaacctataggagaacataatgaccccgccgtcactggcttctgaggtcgtccgcacctcgcccctcacggcgggggcgttgtacctcaacttcatcagcacctatggcgcagccatcgtcaccacgctcgccatcctgtacgccatcgcacagttctactggcgcgcacgcgaacaccgcaagatcatgggagacaagaatggcgaatcccgcaagtgaaggcgcgctcggcgagctgcacgtcatcgtcgcaacggtcctgaaggagcggctgcgcaacgatgagctgtgtaccgctgccgacatcaacgccgcgatcaagttcctgaaggacaacaacatccaagccacgcgcgaggccaacaaggcgctcgacgagttggccgatacgctggagaacaaggacgtgtccgaggccgaggaggccgagctgcaagcagcgctggacaacatcgttaactttccggggagcgtagccaatggcgcatgagtccgcagaggcggccgagctgcgccgcaagaaactggctgtgctccagaagcactacgcgcacttcgccgtcttcatgcgcgacatcatgaaggtgctgggcttcacacccacgtggatgcagtacgacatcgccaactacctgcaattcgggccgaacaacctgatggtgcaggcgcagcgcggcgaggcgaagaccacgatcaccgcgatcttcgctgtgtggcagctgatccaagacccgcagcaccgaatcctcgtgatttcggcgggcggcaccaacgccaacgagacggcgacgctgatccagcgcatcatcctgaccgtgccgcagctcgaatgccttcgccctgacaagaacgcgggcgaccgcacctcggtcgaggcgttcgacgtgcatcacagcctgaagggcatcgaccgctcgccctccgtggcgtgcatcggcgtcaccggcaacctgcccggcaagcgcgcggaccttctgatcgccgacgacgtagaatccaacaagaacagccgcactgccgcgaaccgcgagctgctgctgaacatcacgctggagttctccgccatttgtactggtcgtccgggaatcccggcacgcatcctgtacctcggcacgccgcagaccagcgagagcatctacaacacgctccccggtcgtggcttcgacgttcgcatctggcccggccgctacccgaccccggcacagcgtgaggcgtacggcccacatctggccccgtccatcgtgcagcgcctcgaagcagacccatccctcgcctttggcggtggcccgatgggcgacgaggggcagccgaccgacgagcagatttacgacgaggccaagctgcaagcgaagctgaaggaccgaggcccgtcctcgttccagctgaactacatgctgaacaccagactcatggacgccatgcgcttcccgctgaagacggagaacctgatcgtgattccgggcggcggaacccgctacccgctgacgatcactcgcggcatgtcccagcagcaccagcgcacgttccagtccagcggcatcggcttcatcatgatggccccgcacgaaatctccgtggagactgcggagcttcagggcgtccacatgcagatcgaccctgccggtggtggtgccaatggagacgagaccgcgttcgcagtgaccggcttcctcaactccaccgtgtacgtgctcgcagtgggcgcggttccgggcggctacgacggggatggcctgcgccacctcgcggaaatcgctgccaagtacaagccgaacgtcctctccatcgagaagaacatgggccacggtgccttcgccaaggtgttcctgccaatcctgcgggagaagtggaacggctcgctggtcgaggagttcgtgaccggcaacaaggaggcccgcatcataggaaccttggagcctgtgatcgcccgtggctcgctcgtcgtgctggagagcgtggtcgaaatggatcacgagtacacgcagcggcacgccaacagcggcaagcgctcggtgtattctctgttccaccagctcgccaagatcaccagccaacgcggcagccttgcgcacgatgaccgaatcgacgcgctggagggtagcgtccggcactgggtgagcaagctcgcactggaccagaacaaggccatcgagaagcaagcgcagaaggagttccaagactggatcaacgatccaaccggcatgaaggcggcgacccgacgagggccgatccgtgcaggccgtccatccatccttgaccgttaccggaggtaacatgctgaagtccgatttctccaactacaccggcctgttcggccgtggcaactacctcgtccgtgagctgctggctctggtcgagcatgccgagaagcacccgcagactgcggcccagctgggcaccctgttcagcgccgacgtggcgcgcgtgcaggctgccatcaccgctgcccagtcccgtgcggaatcgtccggccccggtggcggcgcgctgccgaccgaacccgagccggacccggagggctgaccatgaacgtcagcaagcgcgtcatggccgcgctgctggccctcgcagtggcgggaggtggggcaacctacctctcgctcgacggggcgcagcagatcgcttcccatgaaggctaccggctggtggcctaccctgacccggccactggcggcgcgccgtggaccatctgccggggccataccaagggcgtgtatcgcggcatgcgggccacgcacgagcagtgcgaccagtggtatgccgaagacctccgcgtggcggagcgggctgtccagcgcaacgtgcgcgttcccctgaagcaaggggagtacgacgcgatggtgtccttcgtcttcaacgtgggtgaaccgaatctccgggcatcgaccctgcttcgcaaggtcaacgccggagaccgccgtgggagctgcaaccagtatccccggtggatttacgccaacaagatggtactgaacggccttgtgacccgacggtacgaggagcaggccatgtgcctgaaggacggaccttatgtctatcttccgtaaaatcgagttgctgatcggagggctgctgcttgcggccgtaatcctcctgtccgcgtactcgctgcacctccgcaactcccgagccaacgtccagcaggactaccagcaggcgtcgggcaacgcctcggccgctaccactgcggctaaggaactcaaaaccgtagtaatcgagaaggagaacgcgcatgccgcgctcgatcaagcccttgcccgcagtcctgagtgggctgacgagcctgttcctgctgatgtcgctgacctcctgcgtcacgataccggctccgcccgcgcagtaccttgaagattgcgccgtaacgtacctcaccaaggagaatccgtcaaactccgacgtagcgaagctcgctatcgaccgagagttcgacgttaagctctgcaacgtggacaagcgcgccctgcgtgcgtggtacgacggctacaagcaagcctgcggttggcgctgcaaggtggagaagtaggcatgacgaccattgtgtgggacggcaagcacctgtatgccgacagccaagtcactgcggacgacatgaagggcacgatgaccaaggctctccgggtccaaaccccggagggtccggtcttctgcgccgtagccggtgagattcacgtcctccgctccgttgtagccgccctcaaaggcggagaagccatcgagccgctggtcagtggtagctccaccgtgcttatcatcaaggacggacaggcgacagtcgttagcggtaagaagtcttggcctgatgacgctccgatcttcattggcagcggcgcgggtattgctcgtggagcgtaccatgtgagcaagtctgcggctaaggccgtggctgccgcgtgcgctatcgacatgtactccgctgcgcccatcgttaggcttaagacgggctgatcgggagctggaccaaattttgatttagaattgcgcgggggccactccaatcaaagctcgcgtgtgcgcccccatgcgccctcccgcgtgacgcgcgtgggtgcgtgcgggtgtatgcgcgcgtgcgcctgtgggtgcctgtgcgtgcgcgtgcgtgggcgttacgcgggcgcgtgttcctctctcctctcgcgtggaggtgtgctggtcaggtagtacaccggcgcactggtgaggcaggacagcagctcacgcaaggcggctggatttgttcagctacggttcagaatgggtgtgcgatgatggctccacgttggaagcacgggccgcacattggatgcaggccacggggccaccagcgggcctacagggcgcacgcagggcttgacaggggcaaccctaccgggctatgatgcggacgcactgagggacgggagggcggcatctgtatcgttttccttttggtacacatacgacagagggcatgtcctgaaaatcgtatcggtctttagccggaagtgaaccaaggggttgacagatagcctagctatagactagcatcctccctgcggtcgccgatgcaagccacacggcaagcattgacagccaagagggttgacagacggttagcatagtggtaagctagtggtcagtcgagtaacaagctatgagcaagccgctgggacgccttcgggcagacgacaagggcaagcggccttagctactggtaggattatgcgaggagctaccctaccgggcttgacaggaagccaagagtaagctactatgcaccaacggtcaggaagcctaaaggcggagcgactactagcggactaccggcttacatggtaggatggtggcgacaggacgcccagtcgagacaatagggcttgacaagatgcaaacggtgcgct

SEQ ID NO: 22 - DNA, 43869 bp, Unknown
  Bacteriophage Xfas304
ccttaacatccgatgcggtagtctacacccatcgcagcaatgcaccgcagcgacaccgttacaacctcgtgcctaggcgtagcagcgtgcctatgatgggcgagggagaccaccggggtacctacacagggccggagggtcggcggggcaggaacgcacgctgagcgcgtgtgagcggcatctgtatcattttgctggacatgtaacacacgggtagcgcactggtgtactacctgagtaacacaccgatacacgatttggtacacgtacaacagatagaccgccgtattgcaaccatcctcttgacactggggggacaaggcccgcacactcactcctagaacggagtcattgtgggtagcgatacggacccttagatgggaacggactagctgggcttacagtgccatccgcttatctgcacttgatgttccaacgtagttggcgagtcgtagataggagttgacgacttaccacccggtaagtgttgacaggtagcttaggacgtgtcaccatagcttcgcagtagttagacaggtgggcttagacagacacttgacaggagtgagacagtaggctagtatgagtctcacatggttaagcaccgcagcgaatcgcagcgcttggcacatgaagaagaatgtattagcctattgacaacgacttgcgagtcaggcacactggatgccaacaaggtagcttacacctaccggaagagtagatgactgcatagcttagggctgatagctcaacgcatgcacactgcttgaccaacgagtaagcacaacgccgatgacgtaattgaatgtggcttagtaaaccacagggaccagactagagtaccgcaaggtatgataggatgcggcgtagctcagagatgagcactcactatctgcggtggaagcccgccacggtgagtaagctagtgtagtgctagcaggtgcgtcaaagaggatagcaagggtgggagtcataccatctgcgcgacaagcagcccgataggttgcttcccacctgagccggtggcttgggtctaatagattcacccgaatgtataggtgccttgtgcatctatatttttgggttgaatcacaagggtcttaacgctaaggctcttgccattcaacctaatgagactaaggccatgacctttaagcagcgcatcttcagcttccgcaagagccgcgttgtccttgacctgcgcaccgatgctcaggcccagcgcattgcggacatcaagcgcaaggctcagcggtatgagaccctgaagcacaccgcaggcaagccctccgtctttcccgctccggctccgatgggctgggagttggtggaggcgtgatcgctgtcatcgcagttgcattcctagtcggcttctctgtgggagtcggctccatgctgtacctacaccggagacacacatgaataccaatcagatcgagcgcaacatcaaggccatctcccgcttcggcaagaagatggatgccttcattcaggacacggcgttgcaggtggcgttgcactgccacaagcacggggaaatctccctgctgcataagctgtggtcggcgatgcaggagttcaagggcgcacgccacaaggcgatggacgagtggatgatccgcttcgccccggtcaagatggtggacccggcgaacatcccggatgacaagttcccgttcaccgtggacaccgagcgcatgctcgatgaagaggggcgcaatgcgctgtgtctggaacaggccaagcccgcgaaccactggtataacatgaagccggaccccaagctggtggattcgctggacatcaacgccatgctgaatgcgctgctgaagcgcgtggacaacgagaccaagaagaatgcggacctgaagatcaccggcgaggataccctgcgcaagctgcgtgaactcgtcacccacatggagtaggccatggacaacgtagatctggtcgaacagttcggctgcggtaatgtggagagtgcgctcatcgtggcgcactacgtgcgggactacgtcgaggcagaactcgcgaaggacggaggcgtgcgcatctcaaccacagggatatgtgacctctggtctgagttcgccgactcgattggggctgccaatcggtggacccgaaaggcgagggacacgctgtaccacgagtggccgcacttcagcggcgaccgtctgtatccggtgccgtgtccgctgtccatgatcgacgcctatgaagagtacatcctctcgcaccgcaacccaagtaccgcgatgggcaaggaggagttcgctttcaaccgcgcgccgcacatgtgggatggggagtacggggagagccgcatggcgtgcctcgtgtacatcatcgacaggctggaggctgcactcaagtaatgcccgtgcccttcgcaagaggggccacggagatacacgcaaagtgggttcgagtccctaccgctcccgagttgtaaccggagcggcatcgcaggcatgcggcgtgtatctccgtgcgactggcacgctaaccgattcaccaccatggcaatcatcgtgaagtacaagaagaaccgcatcaccaagaccaacggcatcactgcgtggcgtgaggaccgcacgttctccgtcgaggtgaaccgcatggaccgtgcgatgggctgcgcttgcatccgcgaagagttctattcctacatgggagtgcgccatggctaagtacaaaggcaggtatcgtgagcttgcccgtaggctggacaggctgatcgagaccggagcaatccggttgttcgccgagcgccacacccgtgggcagatcgacggcgaggagttcatcggtacgtaccttgccgggggcttcaggctcgtcggctatgggtactactcccaggtgttcagccactggcgtgcgccgggtgtcgtgttcaagtacacgttcgatgattcggactgcatgctgtatgtagcccgagcattcatggaactgatgcacgagaacctgcccgaggtgcacatgatccactcggttgaggtggaggagactaccgagtacggaacgcgagtggtgcggacgcacggtgtggttgtggccgagcgcttgctcgcatgtccagaaggtctgacttctcgggagatgcgcgagcttcagagggaggcagagcgcgcggtggccgacccactggacgagtaccgcatccgcctctcggacatgcactccggcaacatcatgtggcgcggtgatacctgcgttatcaatgaccccaccacttacgtgaggaagaaatgaaacactacgactatgcgcacgagggcaagagctatgaagaactaccccatccaatcgtacgccgccgagattcaggcgctcgccgagcgtgtggtgtcgagcgccgggagcgccacgctgcacgaaaggcagggcaggaactgcggagggccaagcggagtggtgcacagtaacgtccgcctgcgcaaggttctcgaacgcacccacgttaagacgggtgaggtaactcgcttcgtctatgatccagacgtgaaggtagagcattggatcggcaacaccctagtaacaagcgacgagaacatattcgaccccgagcattatcggaggtcggtgttccatgtcttcacactaaccgaagaggagtacgaccgtgagcaataccaccgcgaaccgtaagcaatacgtcatcgcctacggcattgacgacatcctgcaccataacggggtgaactcggaacccgttcgccttctgcccgaggggctgaagaagttcatcgatgccatcaacagcgcggacctgcggcgcatgctgagcccggccgaccaggcgagtcgcaccgaggtgaccaaggcgtggtcgcaacagcagtaccttctggttacccggcgtgctgcggcccgtcgcatcgtccagatcctcaaggctgccggttaccactgccgtgatgacttccgcctgatcgaggtgggcagcacgccgcgagaggtgaagcccgtcaagcactggaacatcgagcggcgctacaggtacgtgtatctgatcggcggccgcaaggaaccgtggtccgatccggaaacctgggaccgtggtatcgccacccgtgcaaacgcacgagagcaggccgaacttcgaacccgcgaaacgaacgcacggtcggaagactatgagtacaagttcactgccgtgccggtgtacgcatgagcatcctgtcctgggcaaagcgtaagttcggcgtcgtgcgtgactggctgttggatcgcaaccccaagcacgaagacctccacccgtgggatcaagtggtggcggcgttcgccaaaccgcagcgcctgcggggccacggctacgtgcagggcgagacgttcgacatcggcatcaatcgtgccaagcgtgcgatcaagtccatcaagaacaagcgcgagcgcaaggcggcacgcactcgcttcatccaacggctgcgtgacagcggcatcaagtaaggagtaacacgaatggcccgtgactacggcaactacattcgcatcgccattccggaggccaaggtaaaggtcgaggcggtgcacaacgcactggtcaagctgatacaggcggccggtggatcgactgccgtcgaaggctggggaagctgggtcgatggcaatggtggactggtcaccgagaaggttatccagtacacctggaacttccactccaccacctacatcaaggtggacatggccgcgcgtgagctggtgaacgcgctgttccgtgcgggtgagcaggccgtgctgaaggaacgctactacgacgagagcattgcggtgcacacccgcactctcatcgggtacgctgcccgcatgctgtacgcaccgaccaagcactgagctaggtactaacatgcagctaatcagagacggcccggtgtaagccaacccacacataggacagagtcgtgacgccaacacatcaaatggcacacctgctcggagcctgaccgagagacaacaacaggcaaccaatcctacctagcacaaggaacaacacacatgacgaacaacatccgcaccgccgccgacatcaccgcccagatcgacagcatcaacgccgccgccgagagcggtaccccggccgacggtggcttcctcaccgtgctgtccctcgaactgaaggcgcgcaacgccatcgagaagttcgagaaggcgaccgccgaatacgaagcgcaggccgccgtgcgtgacgtgaagcagggcgacgccgtgtcgctggtcttcggccgcgccgccaacaagcaggtgctgtcgggcaacgtgctgagcatcgagtcccagcccaccggcctgctgttcaccgtgctgaccggctcgggtgccaagtccaaggtcgtcaacgtcggcgccgacgcgctgctgctgtcgccggaagccgtggccgccgccgaagaaagcatcctcgtcgccaagctggaagccgagcaggccgccaaggacaagggcgagggcaagtcggagtaatactccggcgtgagtaagtgcggtgtcctctcgaaagagagggcactgcgatgcacactgcactaaggaaccgggcacgctgcccgaggtcgtccgaaggtggtgtcctcacagtccagcgggtagctcccgactgagtgtgcatcgcagtgcactccgcactatcaaggagaagacaatgagcaagcagttcaagcagtacatcatgcacgccctggataccgatggcgaactgaagccgatcggtgtgttcacctatccggcgggaaccagcgacaagcaggtgaaggctgcggtcagttccaaggtgaaccgtgcgccggagaacctgttcatctcggacaccacgctggtggagttacgctaatgcacgaggtgcttcacttcctcgccaacgtggggcttgggttggtcgtgctgagcctaatgttcatggcactatcgaacctgcgcatcgcagtggatgctccggctatcgtcggccgagtgaaggactctttcattgcaggggactggccatgcccgctagtgtacgagtacctgacacgccaacgggctgcgcgccttggctggtacgggcgcactgtgcagcgcgagtgcatcctcgccaacctgttcttcgtggtcggcgggcttgcgctgtggccggacatcctgatccacctgtggtacgcggcaagctaagccgtgctgtacgccttcctgtacgtggataaggatggcgtgaagtctgagcggcaggtcaacgttgacaccataggcgctgatcatgtgacaggtactgccggggccgacgctcccggcgtaccttccgcaaagatcgcatcgtccgccacgagatggtaattgtagagtcaggtgagatacttgatgtgatgacaggggaactaagatgagtcgcctcgccgatgacgagtggttgccgcaggcacatcgcctgctgataggcggtcgcaactcagcgcgcggcgaccatgactgtggtgcacccggctccctcatgctgacccgtgacggagcaacactcacagcctactgcttccgatgcggtggcgtaggcaagcatatgacgcaggagaatcccaaggaaaagttcgagaggttgcagcggcaggcaatggctgacgagttcctgcgcacagcagtggacccgcccgagccgacgacgtacaacccggccaagtggcccgagcgggatgcgttatggttctatcgaatgggactctctccccgcaggatcaaagaactagggctgtactacaacgccgagtccggacgtgtggtactaccgatccgcgaggatgaccaagtagttttctggatggcacgctcgcagacagccaagccaaagtggattggcccgcgagttaagaagcgtggtttgtttgccaagttcggaaggggactaggcagccacgttgtgctgaccgaagacccgctaagcgcatacaaggtgggcttagtgtgcgaggcttggtcactgctcgggacgaaggtgcacagtcgccacgtcctgcaactgatggagttagggaagccggtagtggtgtggttggatgacgaccacgaccattactccgggcgtaacccagggcagatagcagcccgacaagtgatcgatgtgctgagaggtgcgggcctgaatgtgcagaacatgactagtccacgcgaccccaagtattacaatcaataccaactgaaggagatgatgaaatgctttacgaacgtaacgtagttggttccatggtcggcgcagtcgccaaccgcatgctgaaggactgcgacggtgtcgtcatcgcgaaggccaagactccgaccggtcgctataccggtgcgttccatgtgcaggctctcggggaggcgcccgacgcacgcatcccgaagtacaccatcgctactatctgcccgccgagtacgtacccgaagtggccgaagcagtacgcggtgaagcgcaccgagtacggcggtcgggtcaccaccgttgctcgcttcagcaaggaggcggacgccaacgagtacctgaagctgcgcaacgagcgcgcgcacaccgaggtcaaggatcgctacaagatggagcgccgtggtccatggctctgcatcatcgacgccgaggcaccggcggccaagttcgccatcgccaagttcgcgagcagccacgaggtgacggcggctgccttcctgcaacgcctgaaccgggggtaatagatggagcgcagcgagcacaccttgctgcgcctcgggttggatcgcaagacccacaccaagctgttcgacattatccccaagtctgcactgaccgggaatgtcttcacgctttgggaggcgcagcgtaagttctacagcaagttcaacacggacaagatcaccgacatacctgcgtggctgacgtggttggaggatcatcagttcgcgaacatgactgacccggatgcaaaggaactgctgcttaccatcgcagggaagctgaagcacgggccggttgatgaggcaatgatccccgctctcgctaatggttacatccagacggcgctgagcatggaggtcatggacatccttgagaagttccaagatccggataacgaggaagacctggacgtgatgttggctggtgccaacgacaagtacaagttgctcatcgagcgcacggtgcactctcccatcgagaacaccagcttcgatgacctgtacgcccaggacgaaacggactatggattccagtggcggctgcccgagttgcggcagcacatgcgccgcgttcgcgcgggtgatgccatcgtctgggctgcccgtcctgatcgtggcaagaccacgaccatcgcgagtgagatgtccttcatgatcccgcagcttgacctcgtgtatccggatcagaacaagacgttcatctggttcaacaacgagggcgacagcaagggcatccgtcggcgtttgtatcaggcaatcctcggtgtgccgcagtcgcagatgatggcgtggcacaaggatggtacgttgctgaacaggctgcacgaggcgtgcggtggtaagcatctgttcgaccgcatcctcatcatgtccatccacgggtacagttcgggtcaggtcatgcgcctgatcaaggaacacaacccagggctgtgcgtgttcgacatggtggacaacatccggttcaatggtatcagcaccaacggcggtacgcgtacggaccagatgctggaagagatgtacaagtgggtgcgtgatgctgcgatcatcgagggcttcgctgccttcgagacctcgcagatttctggtgacggtgagaacgtacagtacccgctgatgtcgatgctgaaggacagcaagacaggcaagcagggtgcgtgcgatgccatcgttatgtggggcgagcagtccggcaacgagcgcggccgcttcctcggtatcccgaagaacaagttggttgtcgaagggcagccgatgaatcctaagaaggagtgctacttcatgccggagattgcacgcatcgtttcattcgacgaagtcaacgaggagtgagtatgaactacgagaacctgacgcaagcccgccaccaagcggagcgagtgctgacccacatcaccctgcatcggcaggctgtccgccacgggctggtcgcaaagccggacgtgtcgtaccgtgcgttgcacgagtgggccgagagcctgaagaacatccagtccctggtcacggtcaagcgcgccgcgcgcaccacggtcaagctgctgttcaatgcccgcagactgtgggtgggcgtgcactactcgcctgcgaaccgccgctggtgcgtcaacctgctgcccggcgtcaccatctgcatcaccaaggcgggaggcgtcgagccgtgatcactgcggagagggagcttaaggttcatggtaagccacacatccgcaagcgggatgggatgtgggtgtacgagccgcgagcggaccgccgtacttccttctggcctgcgaactatgcggcgatgcgctggtgtctccacatgaacggaggttagcatgagcaagtacatcgcgtgggacatcgagacggggatcaagcgtgcgctgaagcgcaaggctaccccgttctatggtgtgaaccaagtgtgggccgtgggctatcgcggctccggtgtggtggacaaggtgggattccaccgtggagttggcgggatacctgacgactacttcgccgacatgctggataagtgcaagatcctcgtcgggttcaacatcaagttcgacatgctacacacgctgcaagatccgaagaactacgccgcgtacaagcggtgggttgtcggcggcggcatgctgtgggactgtcagcttgccgagtatctgatcgagggcatggacaagaagtggcacatgcccagcatggacgaggtggctccgaagtacggcggcaacctgaaggacgatgcgatcaaggcttgctggaacaacggcatcgacacaccggacatcgaccccgacatgctgatggattacctgatgggcaccgatgagccgggagacctcggtgacatcggcaacaccgaagtgatcttcaagggtcagcttgaggtgctgcgtgcacggggcggcatcaagtccgcgatgctcaacatgggcggcctgatgtataccatcgaggcggaactcaacggcatgaagattgccgaggagcgagccgaagagttgcgcgtcgcgctgctcgctgagctagaggcagtgaccaagcgcgtcgctgagtacataccagcggatttgcccttcgagttctcgtggtcgtctcgcttccacaagtcggcgctgctgttcggaggcgacatcaagtacaagaagcgcgtgcacaaggaggatgaccagggcaacaagctgtactccatgcgcgacgaggtgcgctacctgtgcaaggacggcagcactgcgaccgagcaggagctggactcctgggatgacgcgtggtccaaggtcgagcggtacgctggtggtgcgaaggccgggcagcccaagacgaagaaggtcaaggttcctgacctcgacaagccgaagatgacaaccgaggatttctactaccacttcgatgggttcgttgagccattgaagtcttgggccagtagcgccgagggcgtgtactccacggcgagcgaggtgatcgagactctgggtacgtgggaagatgcgcccccgttcatcaaggactacgccaagcaggcgaagatcgccaaggacttgtcaacctactactgggttgaggatgaggacggcgagcgcaagggaatgctgtctctgctgggaccggacggcatcatccatcatcaactcaacatggtcaacacggtgacggcccgcttgtcttcgagcgatccaaacttgcagaacattccgaagggtgacaagtccgatgtcaagacggtgttcatctcccgcttcaagggaggcagcatcgtgcagtcggacttcacctcgctggaagtgtacgtgcaggcgaacctgtcgcgagacaagaacctcatcgccgacctaaagacgggcatggacatgcactgcgtgcgcgtagcgcaggcgcacaagctggactatcagttcgtgcttgcgcgtgcgaaggatgagcaccacgaggaacacaagaagtacaaggcgctgcgcaacaaggccaagaacttctcgttccagcgcgcgtatggtgcaggtgctgcggccatcgcagcggccaccggcatgaccgtcgaggaagtcaaggcgctgatcgaggctgaagagactcggtaccccggcatcgtgcggtacaacgacagcaacctgcgcatgctgcagcggaatcgcaagccgtcgtcgctgttcgttcagcatgatgaggtgcgcggactgaccgtgaacctcggcaagtcttatctggaaacgccggacgggaagcggtacgtgctgtgggaatcctgcgcaccgaagttcctgtacgagcgggacggtacgacggtcacgttcaagccgacgaccctgaagaactacccggtgcagggcatgggtggtgagtgggccaaggctgcgatgtggctgctggtccgtgccttctacgagaaggacaactacgacggcaaggcgctgctggtgaatcaggtgcacgatgctgtgtacgcagacgtggcagaggaagtacgcatcgacgctatggcccttatccatgcgtgcatggaggaggcgagcgtgctgatggagtaccagttcgattggaagatcgccgttcctgtgccgactgagaccgtgtacggggcaagcatggccgaggaacatggcgagcctgcgatgcgtgatttggtacacgtataccggaagcacattcgcgaccgctacatcaagggatacgtcccatcattcgagaaggaggagtagcacaatggcactcaacgcagcaatgaaggcacgcctggcgaaggccaagcaggtcggccccaacatgaacgaagcgcagcagggcggtggtggctacactcctcccgctgagggcgtgacccgcctacgcctcgtcggttacttcgaggtcggcgaacacacggagcagtccggcaagttcatcggcaagaagaacaagaaggtgcagttggtgtgggaactgagcggcaagaaccacgagcctgccgagcacgagggcaagaagattccgattcggatgacgcaggaactgaactactcgctcaacgagaaggccacgttctacaagttgttcgtggaactgaatgcctgccatggcaacgaggccaccatcttcgccgaactgctgggcaaggagttcatcggcaacgtcgtgcacagcaccaagggcgagggcacggcgaagcgcacgtacgccaacctcaccaagatccgcaaggccgtgcgtctggacgaggacgacaacgaggtgccggtgaaggtggacgatccgatcacagagccgaagttcttcgtgtgggacatcgcgacgatggaagactgggatgccatcttcatcgacggtgagtacccagagcgcaaggacaaggacggcaacgtcatccagaaggcgcgcagcaagaacgtccttcaggacaagatccgcagcgccaacaacttcgacacgctgcccatcgcggagttcattcgtgctggtgtgagtgcgaaggatgaggcggacatggacgaagcgctgggcgacgacgacaacacggacgccgatgccggtgaggacgaggtgcacaccccggccgacggccacgccgatgtcgatgacttggtgtaagccatgaccactgcggccgagcgtctgaaagaacacgcccgcaacgcaccgatgccgggtaccactgcccggccctcggtcgagggcatgccactccacatcgacggtgactacgcggcatactactgcgcaggcaacgacgagacctcacccggcaccgcacggcagaacttgctggatcgcatcgagcgtgcgaagcaggtgtctggtgcaactcgtgccatcgtgcacctgtccgaccgcgcatgcgacaaggggctgcgcttcttcatcgcacagtccaagccgtaccaaggtcagcgcaacacggggcgcaagccccagaactgggactacctgcgcgagtacatggagacctacgagggcgatgccttcgaggttaagaactggatcgaccgcgaggccgacgacggcatggcgtatgtgtccgaggcagcctacaagatcggtaggccgggcgcggtgctgaccgccgacaaggacatgcgaatgttcgccggtctgcacatcgtgtggaagaccttcgagatggtggaggttctgcccggtacctacgacaaggtgcacgacgggaagcagtacgggcacaagtggttctggatgcagatgcttcagggcgacacggcggacaacatcatgggcctgccgcgcgtcggggaagtggcggcagagaagaccctcgaaggcaccacctgcaacgccgaggcgtatccgctggtgctggacatgtaccgctcgaagatgcgcgatgcctacgccgaccacttcgtggagcaggctgcgctgctgtggatgcggaccgacaagagtgcacatgtcaacgactggcgcaagctgatcgaggactggggcaccgacatcgaccgcgccgctgcacggcttctcacccgagtacgggaggagcgcgatgctctctacgcctcgaaggcttaaggcatccgaggttgcaactgtgcgtgcccgcattgctgaagagcagggcgggcgctgcaagttgtgccaaggaaagctgggtaccaaagcaccgctcgaccccgtgcttgaccacgaccatctgacgggagcagttcgcggtgtgctgcaccgtggctgcaactctctgcttggtaaggtcgagaacaacgcactgcgttacggtgtgcatgcactgtccgcgttctgtcatggactggcgccgtacttccaggcccatgtcaccaacatcaccaacctgctccacccgaccttcaagactgcggacgagaagagactcgctcgcaatgcgaaggcgcgtaaggcgcgggccaacaagaaggacactgcatgaatgtcacactgaaacaactcctcaagcgtgcaccgaagcacgggccgaagatcatctgcctggacatcgagacgttccccatcgagttctatggttggcagatgttcaacaacaacttcagcgtgccgcagatcaagcgggactggtcgctgatgtcgttcagcgcggagtggctgcatgacgacggcaacttctacatcgaccagcgccgcgagaaggacgtgttcgatgaccgcaagcaggctgctgcgctgtgggccatcctcgaccacgcagacttcatccttgcacgcaacggcaagaagttcgacctgcgcaagatcaaggcccggctggtgatcctcggcttcccgccgctgtcgccggttggagtcatcgatccgatgctgctgaatcgagtggagttcgcgttcacctcgcacaagctggaatacaccacgggtgtcctcgtgccgaacctgcgcaagtacaaccacggtaagttccccggcttcgagttgtggctcgcctgcatgcagtcgctgcctggggcgtggaacgagtgcgagcagtacaaccgcatcgacgtgaagagtatgaaggaggagtaccttcaggttcgcggctggtactcccagcatccgaacatcgcggtgtactacaaggccgacggcagcacccaccgctgcaacaagtgcgggcacgacgagatgatcccgcaggacaagcccgcatacacacaggtcggcacgtatctgctgctgcaatgcacgcagtgcggtggacacagccgcgcacgccgactcaccaccaccatcgaagagcgcaagcacgtaaccgtgcccgcctaaaggagaacgcatgagccgtatgctggaagcgtatcgtgtacaggtcgtcacgtcgaaggacgtggagaacggtgcaaccaagggcagcatcctgtggctgcacagcgaagtggaagaccagccggggtactactacttcatcaactccccggactccgacgtgggcatcccactcgccgtggcccaggtcacacgcgacgaggactgcaagcgctacgaccgctacctcgtggagaagccgcagcccgcagagccgcagcccacaccggtggaacccaagcccgaggtgaccatcgcccaggagtgggcgtcgaagatcgagccgaacccgcgcggcgcgggcctgaagttcgacgccgggaaggtgcgcccctccctcctgatccgtggcatgccgcgtgcgctcctgcgcgttgcggatgttctgaccttcggtgcgcagaagtacgaggcgcactcctggcgtacggtcgagaacggcgaggagcgctacgatgacgcgaagctgcggcacatgttcgcagacgcgctcggcgagcaggccgaccgcgagtcttccatcgaacacctcgcccacgaaatctgcaacggcctcttcctgttggagaagctgctgatcgagaaggagaacgcacgttgagcaccgcatccaagaacgccgcacgcatcctgaagtacaccgacaccagggttcgcctgggtgacgacatggatgacgctgtcacctacgcaatcgcccaggtgtatcctcgccagtccgaagattcccaggccgacatcttcgctgctatccgcagcgcgttcgatgagtacccgaacggcaccagccgaaagatcgcagtcatcggccacctgcgtcggtggcagatcgggcggatctatgggtaagcagaccaaggcgcgcagtgtcaaggaagctggtgtgaatattctcatcggctacaccatcaactactccgcgaacgtcaccctgctgccgatcctgtgggacaaggatcacccgttcctgagtgcgcacgccattggcgttgcgttcacgctgatcagcttcgtgcgtcagtacatcatccgccgctggttcaacaagggagactaacatggcgaagaccaagtacatcacgcacactgcgtgcgagttggagaaggttccgaaggctgccaagatcaacgaggtcatctcctcatacctcgtgcagatgaagtacgacggcatctgcggtgtggtgatctacgatccggatggcctcggtgtactcgcacagaccagaaccggcgagcgcatcctgaacttcaatcacgtactcgatgcgctggacacgctgccgttcgacatcctggccgagcaggtgcgggactccatcgacgtggaaggcgagccgctgcctgtgcagtgcaagcgcggcgtctacatcggcgagttctggcacccggacttcgctgcctccaccgtgtctggcttcaacaacctgaccgacaaggccaagatcgctgcagtgcaggcggacatcagcaaggttcagttcgtcgtgtgcgacttcgtgaccatcagtgagtggttcgatatgcacaccgacgtgggtttcgcggaccgcatcggccgcatcgcgtggatgcagggcatctatcaccccgacgacaacggcgtgttcggcaagaacatccggccgcccgcgccgccgatctggttcgcaggccatgagggctacctcagcgagcaggcggcagaggatgtgtacgcactggccgacgaagccgtggccgcaggccgctacgatggcatcatccttcgcgccgagagcggtccttggacccagggtgcgcgagaccacaacgtcgtcaaggtgaagcccttcattacccgcgacctaatcgtcgtggatgtcgaggagggcaagggcaagtacaagggcatgcttggcaacctgatcgtggaatacaaaggcaaccgcatgggcctgtccggcatgtccgatgccgagcgtcgtgagtggtgggcaaatcctggcaccatcatcggccagattgtggaagtcaaggcgatgagcgagagcgtcaagggcgtgctgcgcgagccgcgcttcaagggcatccgctacgacaccgaggtggacgcatgatcgacgtcaccgtggtgaacaggcccgaggctcagatggtgcgcatcttgatcgacgtgcccttcgagcagtacgcaagcgcgctgtacccgaaccaagttctgcgagacggcgttaacgatgcaatggacatcgtgcttgcggaggcacaacacaaccggagataacatgcagacacagcaggaactggaagaagagatgtacgcctacggccgcacccgcatggccgacagcatcgccaccaacgaagagaaggggcgggctgaagctaacccctatgctcagaagttgtaccgcaccttcctgttcccactgcgtgacctgctggtttcggagttggccgagcgcaagcccggccgccgtcaggcgcacgctgctctgctcgctggtatggacatggatgcggtggcatacctcgcggtgcgcaacgcactcagcaatgcgatgcaggacatcagtgtacgtgcagttgcgatccacgtaggcaaggctgtgtaccacgagtacctgctgtgtcagttcgaggacgctaagccagagttgttccactatctactcaacgacatcgaccgccgcatgtcttcggacgagcggtacaagatgaatgtaatgcgcaaccaagccaccaaggcgggagtcgagttcaaggagtggggcaacgcgcatgtgcagcaggtcgggtactacctgatcgacaagctggtgcaggttggcatgttcgaggtgacgaacaaccgcgagggaatcaccaacgtggttgagttgaacctcacccctgctgccgaggccatcgtatcgcagatcaccgagttcgttaccgagatggcaccgtactggacaccctgcgtagagccgccgaaggactggacatcgttgactgagggcggctaccacaccgagggcatgcgtcgcctcgatccgtacctagtgcacacgcacggtacagcccgcaggttcttcgagatggcggacatgagccgagagttccagtgcatcaacgcgcttcagcgtacgaagtggagagtgaaccgggacttgctggacatagcaacgaacgtgtcgtaccacttcgacatggaagagattatgatgcaggcggacttgccgaagcccgcgcgccctgcttggcttcttgatcagaagcccgaggacatgaacgaggacgaactgaagtccttccgtgcatggaagcgcgagatggctggttggcacaccgatgcaaagctgcgcaagctcaagggctaccgatttgcgaacgtgatgaaggaggcgcgcaagttctctgactatcctgccatctacttcgtgtacttcatggacttccgaggccgcaagtatgtcaagaccaatggcatatcgccgcagggttccgacttgcagaaggctatgcttgagttcggcgagggtaagccgctgctgacccagggtgcgaaggattggttcatgatcaccggggcaaaccgattcggtgttgacaaggtgagctacgaggaccgcatcaagtgggtgcgcgacaacgagcatctgatcttggactgggcgcgcagcccggttgaatcctccgagtggatggaagccgacaagcccttccagttcctggcgtggtgcttggagtacgcgaagtggaaggtgcacggggacaagttcctgtcgcgcatctcggtcggtatggacggaagctgtaacggattgcaaaatttttccgcgatgctccgagacccagtgggcggcaaggcagtgaacctgctcccgtccctgctgcccaacgacatctaccagatggtggccgaccgggcgacggagttgcttgagcttgccgaggaagaccctgatgggttccgatccatgtggctgcggcacatcctgacgcgctcgctcgtcaagcgcagtgtcatgactttgccgtacggatcgaagcgcacatcgtgcaaggacttcatcatcaaggactacctgaaggctgggaagttcaaggagcttgacccgaaccagtacgagcgcgccgctgcctacctcagcttcaaggtgtgggaagcaatcggcgacgtggtggttaaggcgcgcgaagcgatggactggctgcaacagtccgcccgcaccatcatccgagcgggagacgagaacgttcgttggatcaccccaacggggttccccgttgtgcaggtgtacttcggcacggtcgagcaccgcatcaacaccaagcttgcaggcaacatgaagatccgagtgctgaccgagagcgacgagacgaacctggggcggcacaagaacggcatcgcgccgaacttcgtgcactccctggacgcatcccacctgacgggcaccacgctgcgctgcgcggacgagggcatgaccgccttccacatggtgcacgacgactacggaacgcacgctgcggacgcgcctgcgatgttcagggccatccgcgaggtcttcgtggacatgtaccagcagcacgacatgcttcaggaactccgcgacgcctacggcatcctctccgagccgccctcgcagggcagcctggacctcacgcaagtccttgattcgccttactttttcgggtgaggcgagtttcagtacacgtacaacagatgaacctactccccggcttgggcttcggcctgagtcggggagcgttgtgctgtctgagttttggtacacgtacaatacaggagaacgcatgtcactcatttcagtacccgcaccggcagacagcctgtccccggaggcgatcaagaagatcgaggcgaagctcggcggtatggcgaatcctcaaatcaacagtggcacctcgcacctggaggctggtcagaaactcggcgttcagttggtgctgcgcatcctccgcgatgggtggaatcagtaacttagcgcaactctgcatctgtctttaggtaccattagtaagcttacataggagacggatagatgggatttggactgagtagcatctggggtggaggtgacgctaagcgtgcagccaagatgcaagctgatgctatcaaagagcagacggctgctactgtgcgacaagctggattggctgctgagcaagctgctagtcagattcgcaatacgatgcttaccgagactgctacgcaatatgcgcagacactactcggtcggcccatggaacaggtcaacgtgcgtctagctccgcaggagcaagcagctacgactgaccgtacccaacgtcagcgttccgttcgtgacacttacctgtccggtggatcgtggttcgcgtaaggagtaaccgatgaatcactttgtcaatacggcaggtgcccgatgggctaagctggacggtgttcgcggtaacatcatccgacgagccgaacgctttgccaagtggactatcgccaaggtgttcccttgtgatagctacaaccagaacaatgaaacgctcagcaatgagtggcaatctctcggtgcgcaggcagtgaatcatctcagcaataagctggttatgaacctgttcgctccatcccgtcccttcttccgccttggtcccaagaaagccgcacaagaacaactggctaccattgcagcggaacaacggaaggcgatggagaacaagctgtcggttgtggagcgtgaagcttccgacgtgatcgacaagctctcactacgcgctaagctgtacgaactgctgaagctcctgatcatcaccggcaatgcgctgatggtgctgaaggataacaagagcatgcgcgtattgacgatgcgcaactatgtggttcgccgagatgtcaacggtgaagtaatcgagatgctgattcgcgagaaggtgcacaaggcggagatggatcaggacgctctgtccatggcgctgcgctctggtcagttctctctggaccccgatggctgcgcacaccacttccggtggatcacattggatgcgggcaagtaccgggaggatcagtggtacaacgacttcaagttgccgatgcagtattcttccacgtatgcgaaggacaaggttccctaccatgctgtgacgtgggacttgacgagcgggaaccactacggtaccggcttggtcgaggactacaagaatgacttcgcatcgctgaccgcgttgtcccagtccaccgtgatggctgcgatcatgaactcggagttccggtggctcatccgcgcaggtgcgatgacctcggcacaggacatggcgaacagccgcaacggcgacgtgttgtacggtgagcagggagacatcactcctctagcctcgggtctggaatcgaagatcgaatccaatatcgccattgcccagcagtacatccagcgcatcggctccgcgttcctcttgcagtctgcggtcacccgccaggctgagcgcgtcactgcgcaggaacttcggatgaacgccgaggagttggaaggtggactcggcggagcgtactcgcgactggcagcaggcttgcaggttccgctcgcggacttctgccttgcctacgccgggtactccgttgccaacacgaacttcgaggcgaccgtgatcaccggtctggccgcgctgtcccgtgtgggtgatcgagaccggctgctggaatacttgcagtccctcgcgatggctgcgaacctcccgcctctcatgcttcagcgcatgaagatcagcaccctgatgtctgacctcgcgtctgcggtcggcttggaccgtgacaactacgtctactccgatgccgagttccagcagatgcagcagcagcaggcacaagaacagcaacagcagatggccgtgcaggccgctgtccaacaggagacccgtgcatgaccgagaatgtgaacccgaatccggccgctaccgagcagcctaccaccgttccgaatccgcaggctgcggttgtcgagaaccccacgcccacgccgcaaacccctgcccccccggccaagaccgaacaggctactccgtacgcggcggacaccggctccaagcagttggatgtcgcgctggggttcttcgtcaaccacctgggtctcagcccggattcgccggaagttgtggaggcacagcgcaccggcaacttcgagtacctgaagggccacgcagcacagaagggcatcgccccggaactgctgagtccgtacatcgcactggccgaaggtggccgcgaggaactgaccaaaggcgtcgaggcgcgacaggccgagcttgccaaggaactcgacggctatgccggtggcaccgagcagcgcgtggctaccctcgcgttcgtgaaggcgaactccaccgacgagcagttggccgagttcgatgaaattctcaaccgtggtggcatcggcgcgcaggcgctgatgatgctgttccagagcaagatgcgtgcggacccgaacgtcagcacccagggcaaggaagcggttgttccgaacgcaggcgcgcaggttccggcgcaggcgacacagtacccgagccgcgaggcgtggcgtgctgcccagcgtgacctgatcaatcggttcggtttgaccggttatcaggctaccccggaaggcaaggcccacgcggctgcgttccccggttaattgttccaccaacaacaactagaaaggagcttcatacatgagcaatatctggggtccgaccaatcccgtcaaccagaaccagcagttgggtgcaggcccgctggacgcgcttcagcaggagcagttcaccggtgaggtcgagcatgcctacatggcaaccacggtgttcgagccgcacttcaagcgcaagatggtcgtcaagggtaccaacaccctgaccaagaaggccatcggccgcacctcgcttcagaagctgggtcgtggtcaggcgccggacggcaagcaggtgaagttctccaaggcgcaggtgaccgtggacaccatgctgctgtcgcgccacaccttcgatgaactggagaccatccagaccgacatcgacgcgcgagccgaagtctccacgcaggcgggccgcgacatcgcggacttctacgaccagaccatcgccatcgccggtgtgaaggctgcgcgcgccaccgccaacccgtacggcctgaccgctgcggatggcttctacggcggcacccaggtcaccatcgcgagcggcgacgaactggatccggccaagctgtaccacgcgctgggtcagttgctgatgcagatggaagagaagaacgtggacccgcgccgcgagaagctgctcctggccgtgcgcccggcgcagtattacgtcctgatggatgccgagcagatcgtcaacggtgagtacatcacctcgaacggcaacaagctcgacaacatcccgatgttcaaggcgtggggcatcccgatcatctcgaccaacaacctgccgaagggcgtggtcaccggccacctgctgtccaacgaggacaacggcaacttctacgacggcgacttcaccaacgtcatcgccctggctatcggcccgaaggcgctgatgatcggcgagtccaagccgttgcagaccaagatctggtactcggatgagtcgaaggtctggaccgtcgatgcgtggttctcgttcggcatcgcgccggatcgcaccgagcatgccggtgtggtgcaggtcggctaatcaacacgggcgcagtccctgaatccttcgggtaactcaaactgcgcccactcaactaggaggccacatggcaaccatcgctgcaaagctcccgttcgctccgggcaccaccgtccagttgtccgctgcggtggacgtgtatccggacaaggccccggcgtacgtctgcttctaccagatcgtcggcaccaccctgtacgtgcaggttcgtgtgcaggacgacagccccgaagtgggtaccttcgacctgttcattccggtcacgggtatcgaggcgctgggtaccccgtaacaagccgccccgctctctaactgagggcggggcattattggatcaaggagagtctaatgtttatcagtaagctcgacgtcgttaatgacgcactgtcgtgcctcggcgaagcgggcctgactgaccttcaggaagaccacgcctaccgggatctgatcctcagcttcctcaaggctgagacggatcgcatctgtgcgcgcggttggtggttcaatcaggagtacacccgcctgctgcccgatgcaaactcccggtacatctacgttcccgaggacgtgtactctgtggtcaccggctgcaatggcttcagcgtcacgcagatgggccgccgcatgtacgacgcgcgccgtcgcacctacgagtgggaccggccgctgcctgttcgactcacgcgcatgttcccgttcgaggacttgccgtacatcgcgacggaggccatccgcgacgccaccacggtgaagttccaaggccgagtcgatgccgaccgcgagaccaagcaagacgccatgcgaactgcggcgaactcgatggagcagttggtccggatcgacgcgcagaaccagaagcacaacatgctgtaccgtaacggcatggagcgcaacgcctggattgcaacgaaccagcagtaccccgcaggggagcgagacatcctcggacccaacatcatcgttcactaggaggcagcatgagcaagaccgtaggcagcttgccctcattggtgcagggcgtatcggagcaagagccgcacaaccgtgcgccgggtcagatgtgggaaagcgtcaacatgatcgactccccgaccaagggcaaggcacgtcgtcgcggcaccgtgtactcgcaccatgtcgagttgccctcggccattgctgaggctctggtggaggcgcgctcccacacggagtacaccttcatcatcgacggcaaggagtacagcctgatctaccgtagccgcgcatcgacgctcggcaaggattacttcgcacaactgctggacaaggacaccgggcagttctacgacatcgtatacgagaacagcacatgggtggacaatctgattgccgggggcgtgtcggccgtggcgtgtatcggacggtacgtatacctcgcggggaataccaccctgccgcgcgcgacttctaccgaagcatggaactctcctgccaacttgcagaagctcagcgcttgggtgcgcgagggtgcgtacagccggaagttcactgtggttctttatcatgtgaacgggaccaagcaggagtttgcttacaccacgctcgctgctgcctacccggaactgctggacacgtcggacatcccgttctacaagccgaatacgaacccgcaggaggttgaccctgagtaccagaagcgagtgaatgatcgcgtcaatgcgtacgagggtgagaagtccgcgtggattcgcaaggctgcggaggacattgtcccggctaacatcgcgcgcaagctcgccgagttgatcagcacggcaggcattgcggcgtcctcgctcggcccttgcgttgtggtagacgatccgaactacaatgacatccgcctgcttgacgacggcagcaatacgctcgtctcctatgcgggcaaggaagtcagtgatccgcagttcgtcaccctgtaccattgggcaggcaaggtcgtccgcgtgcggccgtccggcggcggggacaaggagagctactacctgaaggccgtggccttggactccactgctactggctggacgaaggtcgagtgggtggaggcagccggtgtggtacacgagattcacaacgtggtctctcagttggtcatcgaccctgcgctgaagactgcgtacgtggcccaggatggtgcaggtctgaagtcccttgctcctcagcttggtgaccacccactgtacaagggcaacgtcgtcggcgatgccatcactgcgccgctgccgcactacttcgggcgggtgatcagttgcatgaccgtgttccaagatcggctgatgatctgcgctgacaacatcgtgaacttctcgcggtcctcggactacctgaacttcttccgcgtcaccgtgctgaacatccaagacaacgatcctatcgaaatcttcgcccacgggtccgaaggcgacacgatcaagcgcgctgtgatgttcgagcgggacatggttctgttcggagaactccggcagtacgcgatcaacgggcgtgagttcctgtctccgacgaacccgaacatcaatgtgatcgggaacttcgagggcggtgtgcgcgcccagcccattgcgtccggcaacttcctgttcttcgggaagcacgccaacgaacgcacgggcctgcaccagatgcagccgggcgagaccgcacagaccaccgttgtgtacgacgtgtcgcaggtgctggacacgtacatcgcgggcgagccggtgcagttgctgggcacgaccatgccgaacatgatcacgtaccggacggatgcggacccctcgatttggtacacgtacaggtacgcagacgagcaggggactgggcgcgtaatgtccagttggggcaagcagcagtacgctccggagttgggtacggttgctgctatcacgcactaccgtggcgacttgtacgtaatcaccttgcgctctgctggtgggaaggactactggtttgcagacaagctcagcctgaacgttgacctcgcgcgctacccacatctggattcccaggttcggtacgggcaggagactccgtggcatgttgctgcgcgctcttcgttgtacgtggcagcggacaagtcctcggactacttcctgctgggcgcaaagcgagaggctgcggaggacttcatcgagcaggctcctggcgtggagtccgcgctggttgtaggttccgtaagccccgcgtacttccagcccacgaacccgtacatgcgggacagccaggggcagccgatcctcaacgggcgcatcacgctcgcgtcgtacggcttccacctcgccgacaccggaggcatgcgggcatacgtactcaagcctgaccgagagcgtaccctgctgttcgagggtcgcgtcatcggaaacaccagcaacatcatcgggcggcagccggtctactccggaatccgcaccgtaagcgtagggcgcgagacgcgcacctgcatcattgaactgcggtcggaggactggcagccgctccgcgtcaccggcgctgagtggtctggtcaggtcttcatgccgcgcgcacgaggactctactaatggatggattgggtaccatcctgcaagcaaacaacatcacccgcgtggctcgtgcgaagtaccaatccgccgttgccacgcaggccgcgaacaacaagctcaagaaagcgcagggggacttggccaactggtcccggtccctcagcaaccgccgacgtgtggaggcagcgcagaaggagttcaatcgcggcgtagagcagttgagcaacgagacccggcaggctggtaagcaggcaacgggtatcaccctggacagttctgagcagcgcggtgcactactggcccgcgctgcgatgactggcgtgggcggctccactgtcgaggcgatggagaatctgatcaacttgcaggctgcaacttcgcaggaagagattgatcaggcagtggacaacatgcagtacagtgcgaagcagaacctgaccactgcgctcatgaacacgtacatgtcgcaggacttctcgcagaccatgatggacttcgacttcaccaagcacatcgagccacagggcatgaagcgccgcctcggcaagctggtaggcgttgcggttgcgacgtactttggcgggccgatggcaggcgaggccgtgtccaatctcgcagtcggcgagtggcaggcaacgaacggcgacttccaaggcgcgaatcagtccttcggtgctgcgatgacacaggccggtggggcgatgcagcagtggagtgaccgtggcggcactgcctggggcgaggatgtgtggcgcggtatgcgtgccaacggaagcaacgcgggtgctgcatccatccaggcaacaggcgggatgtccaccaagaaggcgcagtctgcgtcgagcagcagtaagtcttggttcaaataacaggaggcaatatggcaggtattcagttcaagcccgtcggtggtctgcaaggcggggccagtggtggcggcgctgctgtgcctaccgtaggcattagcggaggaggtggtgcgagcagcaacacgccgatgcgaagtggtgccgaatggttcgaccggggcatgcgggcggacttcggtggtgaccttccggggttcctcaacgaggtcttcgctgctccgctcgcagtggctaagcaggagcgtgagtggaaggggtacaccgatgccgctgccggtgtgaccgcagaagagatccgtgcacagcagccgtggtacacgaaaatcttcgggccgactcagtacgagtccggcgcaatcgcgttcgagaatcagaagaaggcttcggatctgatccgcgactggacgctgcgcatgccggagttgcggcagatgcccgccgagcaagtgagcgcacagttgcgggagcagatgaacagcatgatggggaacaacccgttcgccaacgctgtgcttcagaagtccctgctcactcagtacgcgccgctgcttgagcagcacggcaaggagcgcatcgcgtggcagcagagtcaactgctgaagtcccaggtcgagaacttccaatcgaactcggccacgtaccaactgctgatgtcgaaggccgcaaccctcggcaccgatcagcccatggacatcaacacggccaagcagttggaggccgcgaagagttctctgttcgatgctttgaccacaggccagttccagacggacgacagcgtgaagtccttcatcatgacgggcatccgctcggcaatgcgtagcggtgagttctacaccgtcgaggcaatgatggacgagaacatcctcggtgcgctgccaatcgagactgccgagcagattcagaaggcgtacatcaccgcgaaggcgcagtacaagaatcgcttcactgctgacaacccggacttcgagaagatgatggctaaggccgcagcctcgcggcacctgggtattggcggcgagccgatgctcgcgcagttgcgggaaatcaatagcacgtactccgctctgacgggtgacccggatgggttctacgactccgcacagatgtcggcctatgcgggcgacgccacctcgtcgtggctgcgtcggttcgagcggcaggaagacaagatggatcgtctgaaagagaaggccgccgacaatgccgcaaaggcggaggtcgaggcgcgcaacacggcgcagttgcaggagttcttcgtcagcggttcgctgggcgaggccataaacatgaagggagtcgagcgcggcgatgccgaccgtgcatccactgcgcggttctcgatgctgatgggtgagcagaaggtcgatcaggcgatgggcaacctcgtgtacaacttcaacaacacgaagggcagctacaagaacgagcagttggctcagcagatgcagacgaacttgcagaacagcatggacgagcaggtgagcgacgccttcatggtgcagcacaagatgtggaaggcgctctacacctcgcctgggtacgccatgcaggacggtgacgtggttcttacggatgctgcgcaaggtcaggccgctgctatcgggtactacggcgagacgctgaaccgcaagatggtggagttcgatcagaagctgacggcgggcatgacctccgaccgtgcgtacgctaccacgttcggtccctgggttgctgctggtcggcccgacttccgtggcatcgagcgtgacgatcagaagcaggcgacgaaggctttcctaggagcgatccgtggtgagtccgctggtatgttctcgcgcatgttcggcaacgggttcaagctgcacccgtccgcagaggcgcagttggcccaggcggttggcccgtactacgagcagttggatgcagggcttctcccggagcagcgcgcgaaggcggcgatgaacctcgccaagcagggtgggcgcatcgagattgtcggtgggcagttcctgcactggaaccgaaaccagcagccgctgacgaagtacatgggtgatcctgatggtgagcgtacctcgctgctgttcgacactgtgctgcgtgagcgcctgaagtccgtaggcaccacccccgatggcaactccatcgtgatcaaccgcctgcctgatgagaagggagacccggtgtacgcagtgcatgtggagacctccgatggtttctacaacgttgacatccgaggctccgacctcacgagctacgacgagaagaagctgcgcgcacgtcgcgagcagatggaggcgccgcgtcagatgctgccaatccccaagcccaactcgaatatccgattcaactaaggaggattcatgaacactcttgatcttgcaggtcttacgctggaccagaagtttgaagcagcgggcaagttcgcgggtgttccctcgcaactgttcgcaggaatgtgggcagtggaatccgggaagggcaccaacatgacctcgcgcgctggtgcgcggggtcacttccagaccatgcccgatactcaggctacctgggaagagcgcacggggcgcagcttcgaccccgacaacttcgatgactccctgaacatggccgcgctgacgatgcgcgagaacatgcagaagttcaagaccatcccggatgcgctgcgtgcgtacaactctgggtgggaccgctccaagtggggcaacgacgagacctcctcctacgtgggcaagatcgcaaccgagggcggcatggccctggccggtgcgatgaccatgacctacaataaggtcaacccgaacggtaacatggacgccgcattcaagggcaaggacttcgatgaggctttgttcgagaaggcgtgggcaggcgaggcgctgggggacttctccgcgcttaaggctgctgccatcaagaagcacctgaccgatgtcgagaagggcaccgccaatctcgctgccgtgcagaccgctgcgatcaacgtaggcaacgccaacgtggcggagcttgctcacgcagcgcaggccaaggtcgagaacgatgcggctgccaacgtggctgcgtacaccgcgactactggcaagtccaccatcgacaccagcacggcctcgatcagttcgggcgaggtgaagaagcgcatggatgccgcgctagagcgtgaggcgtatgcgcagtccctgaccgccaccgacaagtggggtgctagcttcggcagcagcctgatggcgggtatgatgcggtactacgacaacgaagtcaacgatgcgtacccgaagggctggtcttatatggactccgcgtatgagcaggagaagggctactccctgcgcgagcgcgagttcctgcgcgaggctgtaagcccgcaggatctggcacgaatccaaggcgacatcgctcagcagcgtgcagatgcacagcttctcggccacctgtcgcagtcctctcgcttcggctggtctattgctgctgggttctcggacccggtgggctgggctgcgggcctgggcgtcggcaaagcggcgcagatggcgaaggttggcgctgcaacgtacatcgcggcaggccgccccatctctgcactggctgctgctggtgctgagggtgccatcggcaacctgatcacgggtgccgctctggatgcgatgggagactaccgcaccttgggcgactacgtgagtgatgcgggctttgggttggcgttcggcgctgtgttgtcggcgcccggcattgcacgcgacgcgcggattgctggtgtccagcgtgcgatgcacgcacaggccgccatcaacgatgcagagcttgccctacgtgcgcaggagatggccgggccgggtgcaacgccggatcagttggcgcgtgcgatgcagactgtcgaggaagcagacgacaatgcgtggcggcaggccaccttgggcaacgttccggacggtgaccgcttcatggcccgtgcaaacgtgggcgaggccgccgatcctgccgtgagctacagccgattcgccaacgacggtgaccgtctggcctatatccagcagaagcagttcgatcagtccatcgcaggcgacgacatgcgtgccatggtggcggagtttagcgtgcgaagcgaggacatcgtgcgtcggtaccctatcgatgaggcgaagctgaagaccttcctgtctgccgtggactttgaggccacatccaccacgctgatggcggataagtctccggtgtccaaggcactcggcatcctcatcgcggagtctccggaaggtgcggcaggccgccacagcactgcatccgtctcgcgtaccgctcacttcgagcagtacatgggcaacatcaaccgcaacacggacaccctgttcgatatgtgggcgcgggagcagggcttcggcactgtgcgtcaggcgatggacccagaggtgcgcatccgattcaacaaggaagtgcagttggagatgaatcggcgctggaacaagcagccagagggtgcgatccaccccgcagtgaagcgcgcggcggacatctacgaccagggctacaagatcatgggtaaggatcagcgccacgtaggtgttatcggagcggatgcgatcgatcttgagaacaatggctacttccagcggtcttggaacctggggatgctgcgaggtatgggtgcatcccagcgctcggcgttcgtcaacgcgctggaagatcagttccgcacagttgcgggcttcaccgacagcgctgacttcaatgttcgtgccctggccgtgacttacctggctcgattggagcatcgtgcagtcggtatgctggacgtgcctgccaatctgtactccaatgatgcgggtgctatcgtccgcgacgccctgcactccctgggcctgagccaggatgaggttgagcggcagatgcagcgtttcacgcgcggtggtgctggtcataccaagtcccgaatcgacatggactatggcaaaaagtacgacgacggtgcaggcaacaccttcacgctggtggacttcctcgacaacgacatgaatggactctaccgccgctatgcccagcgcactgccggtgacgttgccctggccaagtacggcatcatgggagagaacggcatcaaggtggcacgcgaggcaatgctgcggactggcgcaagccagaaagcgctcgatgccttcgatcagttgatggcagagatgactggcaagaaggtgggcacaggcgatccactgatcgcacagaacgcgcggtccctgaccaacctgtcccgcatgggcggcgctgtgtttcctcagatgggtgcttacctcgacgccgttgtcggcctcggtgcggtgcgtgcactgcgttctgctggtgcgatcaaccagatgcgcaaggaagtgcaggccatggtgcgaggtgagaaggtgcacaacccgatcctgtctgggctggaaggtatcggccccgagttcggcactgcggactaccgcatcttcggcatcttcgacactccggagatggcagacatcgctggacgtgagtccgttggtgtggtgacgaaggcgatccgcgccggttccaacttgcagcgcgttctgtccggacaccgctgggttaccgctgcgcaggagcgcggcttcgcggaccagatcgtgcgcaaggctgcgcgcttcctgcgtgaaaccgatccgggtgttgacaatgtggccctgaaggacatgggcatcactggcgagatggcaaccacgatgcgtgatcggctgaagaagatcgccaccttcgataagagtggcgagttgatgtcctttgacccgcgcaagctggacgttgacgacatcgcaggccgccgtgcagtgatcgcattccgcgatgccgtgatgcgcggcacccggcagatcatgaacaaggagttccccggcgaagtcggcaagtgggcgcacaacggttggctgaagctgctgttccagttccgcacgttctcgatggttgcgcagcagaagtcctttaaccgcatcctgcacacgcgcggtgcggcgaagctgactggcctgctgctcggcggcatggccgtcgctgctccgatccacatggctcgtgttgcactgcgtgcctccttgatgtcggagcaggaccgcgacgagttcatggagaagcagttgcacccgatggcccttggccgggcaaccatgaactacctcgctgcgatgggcctctgggccgacgtggttgaggcggggagcggcctcggcacggggtgggcagacgccttcgggttcgatatgccggagtccctgaagcccacgggtgggcgcacgatgaaggatacggacctgatcggcggccagttggccccgtccctcggcgtgatcaacgacatcgggcagggcgtcatgggcaagccggacaagctgtggaagtccgccccgttcgcctcgctgccgtacatccagcccgttctgatgggcattgacagcgccctggatgagggcgagtaacagaccaatgcgggccaaggacggcccgagttttggtacacgtacaacaaggagaagacatggcgacgatcaccgatccaaccttccgtttcgccaccaacgttttcgacacggatggcacggacaaggtgtacgacattagcttcgagcttggctacatcgacggtgaatacgtcgttgctatgtcaggagtcgaagaccccgatactaagctgctgaccgacatgcaggcgcacactgttgcgtttactgacacgcctccgggcactcgtgttaaggtcagccctgtgccggtctctgggcgcaagctcatcatcttccgtcagactgacatcagcaaactgctggtgaagttccaagacggaaagcttcagaccgggcgaaacctggatctgaactccacgcagttgatcatggcgatccaggaaatccttgacgggttgcgcaacaacaaccttatcgtggagcagcagatcggcacggtcgttgatatgaacaagctgatcaaccagatctaccagcaggttctacaactcctggcttctggtggtatcgtgtctgtcacgccgcgcgtgtggagtggagtgtggtccgaggcgtccgagactctgggcgacacggacttcgagattcccggcgcggacgtgtccggtgcagggttctacgacacctacatcgagggcgtgggcttgcagcctggggaggacttttccatcatcctcggcgacaacccgactattcggttctcgcgcggagactggcccgacggcactcggtggttcaccgtgcttcgcgggtatgccaagccgtacaccggcccggctcccgtcacgaccctcgcgtacccgatcatccgaagcggtgcctcggcgtacttcattgaccagacctctgcgttctctgtggtcttgctgtcctcgccgagcgcggtgaccgcaacggtgaagctcatccctccggccgcttccaacaaggtggccaccggcacgttcatcacgctggttcagcgcggcggggtcgtgtccctgtctgccgatcctggcgtcaacctgatcatccctgccggtaccatcgcgcgcactcgcgcagccaacagcgcactgtctctgacgtgcctcgatgctgacgcgaacgagtggttggtctccggggatcttgcaaagcaggagtaaccaatgcactttcgtctgttcgaccggccgctgatcgtagacgatcctctggctagtatgtacatcgacggacagtacgaagactacaacccaggccaagcctacgagggccgtgtgcaaattcacggtgcggtgggctttgccaaagtcgaagtgctgagcgccaacctgcctcccggctactacgtctacgtggacaacgtgacgaaggaggtggttgttcgctggagtccctatactccgccgaccgagacttttaccttggtcgagaatggggacttctccgcaggggacaatggggcctggacgaataccggcgccgatgcgccgttcgtgatcgagcctgatagtggcggcaacatgtcgatgaagttcaaggaagggttcggcggtgggtactactctgagagtgtactagctccgatcaaggacatcaatcgacagatcaccgccaccgggcgtatcgcacaaggcaagtcgtccaagcgcaagctgtggggcggcatcgtactcgcgttccatgatgctaaccgcaacctcctgaactaccttgaaagcaactgggtcaactccgggggcgattacaaggacgttaaggttgttgcggcggccgcagactcgaaggcgaagttcgtcagcgtccgcatccagttcgatcgcaagggccagaactacccggcctgggccgacgacatcaagtgggaccactcgtggacgaagggatacaacgacgacgagcagttgtcggttaccgtgcgagtcacggactcccttaacaacactgccacgcacaccggcactatcgatgagcggagcaactggtactacggcaagctcaatggcttgtacatgtacgacagcctcggactcaccggtaccgcgcttggtattaacttcggtgggcagcagcatggctccgactacgccgcactcagcggttccgtcacgagcttcctgtccaacactgtcgtcaaggcggacctgaagtccatggagtccatctccatctccggtgcaattgctagcatgcggcagcgcaacgtcgctatccgctacgtcagcaccccggaggcagcatccctcagcggccgggcgtcctcgttcaagagcaagacgcatgtggactacaagcgtgcgcgcgccgaaaccgtcaccatctccgcacgaattggaggcttcagaatcacatgatcaacaacaaggtaggcgtctccggacgcttcaaggtgcaggttctgcgctccgatggctctgtccgaatggatcgtgactggcagaagaacctgatcacgaactatggcatggaccacctcagcagcaagcaccagagtacggtcggccaggccaacatgatgcagtacatccgcgtgggcactggctcctcgactccggcgaacactgacgttgccctggcaaatcaagtgggctacaaggattccgccgggcagtccacgcggatcgctcctgtcgcaaccgatgcttcgccgtactgcggttggcgcgtccggtacgagttcgcggctggtgccgtggtcgggaacctcacggagcttggcgtcagccactccgccgaaggcaacaacctgtgcacccacgcgcagttcctggactccaacggtcagccgatcacggtggtcgttgctgccgacgagcagcttatcatcacctacgagttccgtctgtacttcccgaccacggcgtcctcggcgtctgtcacagacccaaacaccggtacggtgtacaccatccgtgcgctgcccgtcaacaccataaactggaattgggcggactacatcctgggcggtgtgctgggcggccagatcggcaactccgtcaacggtgcgcaggggtatgcctactacggaagcggcgcgggcctcagcagtgctgtgtctcctgtccccaacggtacaaacgtgtcgggcacgttcaactacaacaccgccctggcaacggacggttcgtactctaccaccactacggtgactgtgccgctgggttctctcaacgatctggacatcaaggtcgtccagaccactgagatgtccccgtcgtacttcgccccgctgtcgtggcagttcgagttcactccgacgtggcgcaagacctcggaccagaccgtgacgttcaccatccggttggagattgcccgcgtatgatccctcagttgaccgcagcgcaggctcgtgcgccgtgggcacagcagatgggaagtcgctccaagcccctgatcaactacgcggtcggtggtgacacccttggcgacagcgctaccatctcaggtaccacctgggttgtagagtacgtcggccaggaggtgcgcgtatacaagctggacgcacccgagacctacagcgtggccttctccggagcagacatcacgttcgtgagtctcgccttcgatcagtccatgcggtgggtcatcgggtacacgcaggccggagcaggcaagctgcactggttcgactcgattgtgggtgggtacaccacctacgtcgttccgggcgcagtgcagcccttcgtctccctcgacgtgcgcgataaggtgtacatcggagcgagcgacgtgatcatcagctacacccgcgacaccaatctctacacccgtgttcagcgggagcggtttgcgacggagcgacttctaaagtccgctgccggtgctgccctctcacgcttcgggctatccactgtcaaccgcctgcaatggcaggtacgaccctaggagtacaaatgaagctgcccgtcagcgttgaactagctgctgctaccccgttgacgggtttgtcgattgtcgtctcttggatgactgcgtactcgtcggccatcgtcaccggcctcgccatcctcgcgttcgttgcgcagatggtgtggcgatacctcgaacaccgcgcgatcatgcgcaagaactcggaggctcccaatggctaagaacgccgcaagcgaggacttcctcggcaccctgcacaacagcttcgctatctacctcacgtcgctcctgaccaaggaaggtggctgcaccgctgcggagcttgcagtcatcaattcgttcctcgacaagaacgacatcagttgcgctgtctcttcggacaacgcggtcggccggttgcgtgagcaactgaagggcgtaggtgcgcccgccgaggtcaccgacaaggacaaggagggagcgctcgcaggtgtgcttgacctcgcccagtaccgggcgggcggtaccggttgagcgccgacaagaactggcgagccgaacagcttgccgtccttcaggagcactacgggagcttctctctgttcctgaaggacatcatgtggtttctcggcgggtggactccaacgtggatgcagtacgacatcgctaactacttgcagcatgggccgcaagacctgatggttcaggcccagcgaggcgaggcgaagtccacgatcaccgcaatcttcgcggtgtggtgcatcatgatgaatcccaagttccgcgtgctgatcgtatcggcgggtggcaagcaggcaaacgagattgcgaatctcgtgacgaagatcatcctgttttgggagccgttggagtgcatccggccggacaagtccgctggtgaccgtacgtctgtcgaggcattcgacgtgcactactccctgaagggcgtggacaagtccccgtctgttgcgtgcatcggcatcaccggcaacctccctggcaagcgcgcggaccttctgattgcggacgacatcgagtccccgaagaactcgatgaccgcaggcaaccgcgagatgctgctcaccctgagcttggagttctcggctatcgcctctgggcagcccggcattccgccccgcatcgtgtacctggggactccgcagaccagcgagtccatctacaacacgctgccgggtcgcggcttcgacgttcgcatctggcctgggcggttcccaactcagaaggagatggcgaactacggtccgcacctcgcgccgcagatccgcaacgccatcgaggctgagccgagcctgcaatacggcggcggcatggctggtgacatgggcaagcccacggatccggtgatgttcaacgaggaaacgttgcagaagaagttccaggatcgtggtgcatcgtcgttccagttgaactacatgctcaatacgaagctcatggactcccttcgcttcccgctgaagaccgaggacatcatcgtcatcccaggtgcgcccacaggcaaggttccgcagatcatcatgcgcggcatcggtgcgcagaaccagaaggtctaccagtcctctggcctcgcgttcacctgcgcgcagcccatgatcgccaacgacgtgcagatgatcgacttcgagggcgtgcacatgcaggtggaccctgcgggcggcggtgcgaacggagatgaaacggggttcgctgtgactgcgtacgccaacagtaccatctacgtgcttgccatcggtggtattcctggcggctacggcgatgagcagatgaccatgcttgcaaagatcgcggagacgttcaaagcagggaccatcagcatcgaaaagaactacggttatggcgcattcgccaaggtctggctccctatcctgcacaagatatggaaggggacgatccttgagccgtatgtgggcggtatgaaggagaagcgcatcatcggaaccatcgagccagtcatcggccgaggatccctggtgttcttcgagtccgccatcaacatggatcacgacctgaccgagccgtacaacacctccggcaaccgcaagatgtactccgtcttccaccagcttaccaagatgcaggcaatcaagggatgcgtcaagcacgatgaccgtgcggacgccctcgaaggtagcgtgcggttctggatcgagcggctgaaggtggatcaaggtaagcgaaaggcccaggaagaggctcgcgaataccagaagtggctcgatgaccccgtgggttggagccgcaatcagcagcccgtgcgcacgtccatgaacgtcagcaccaaatacttcacataaggagaagcatatgtatcgcagtgacctcagcaattacactcgcgcctacggcggcggcaatcagttggtcacggagttcgtgaagctggtgggctacgtcgaggtgcacccgaactccgccgagcagatcctcgcgctgttcgatgcggacgtggcgaaggttcgcgcagcgatccaggcccagattcctgctccgcccgagggcgagtaatgaatagcttgccgctgatcgcaaacgcaaccaccatcggcgtcagtttgatgcaggcaaccacccaggaagaggcccgcgctgtcattggcgcgggtactggcggtggtggctcaggcggtgccgtggattccgtcaacggcaagaccggtgcggtggttctcactgcctccgatgtcgatgcgctgcccaccaccgccgccggttcgtccctcgcaaccctgagtggaggtaagatcccgaactcgcagttgcctgctctggctatcaccgagacgtacgtcgtcagttccgaggcgtcccaggtcgcactcgtagcacaagaaggtgacgtgtgcgtgcgcacggacctcgcgcggacgtacatccacctcaacactgccctgggcacgatggcagactggcaggagattctatctcccaccgcaccggtgcagtcagtgaacgggcagactggcaacgtgtccatctctgcttcgagcatcggagcggctaccacctcggacctcgcgaccaaggcaaccatgccaggaggctggactgcaatctcctccttcctcaacgggtgggttaacctgggaagcgcagacttcaacgatgtgcagtaccgcaaggtggacaaccgtatcgacctgcgtggcgtcgtcaagaaggacaactccactcgcaactcgatcttcaccatgcctgcgggcttccgtcctaacaggaacctgatcaacctgtgccttgcctacgctggaggcaacactatggcgcgcgtggacgtgaacatgaccggagatgtttcccttatcgatctggtcaacggagcctcggagtccaccggcattgtgttcctctctctggacgggatcaccttcgacattatctaaggagacactatgaagagccgcatcctcgccctgttggcgggtagcctgctgtccgtggcaggcgttgtgcacgtcatggacagtgagggcatccaccgcaaggcttatccggaccccggtactggcggagcgccatggacgatctgctacgggcacaccggcaagaaggttgtcaagggtctgatggtatcgcaggagcagtgcgaggcgtggctcgtccaagacctcaaggaacacgagggctatgtgcagaagctggtcaaggtgccgctccgacagggcacctacgacgccttggtcagcttctccttcaacgtagggccggacaacctcgcgaagtccacccttctgcgtaagctcaacgcaggccaatggcatgctgcctgtgatgagttcccgaaatggaagtatgccaacaagatcatcctcgaagggctggttgtacgccgcttcaaggagcaggccatgtgccgaaaggagggattgtatgtctaccgtccgtgattacatcatcattctgctgatcacgctgatcgtgggactgggtgcggctactttcatgctcaacaagcgcctcgacgcagcgcttgagcagaaggaaaacgccacctctctcgtcaagggctacgaggagtacacctctagcctcaacaagttcaccaaaaagcgggaggaagtccatgcggaagcagaacaagaccgtgttgtgcatcaagagtgggctgatcagcctgttcctgatgaccttgctgacaagctgcgcgagcattgagttcccgaaagcttggttggatgactgtgcggtgacctacccagcggatggtccgatgactcagtgggatttgtaccttctggctcaggatcgtaagctcgatgtggataggtgcaatgtcgataaggctgctcttcgtgcgttcgtagagtcccaccccaagctgagcatcaagaaatgacaactatcgcctgggatggtgagtacctgtactctgactcgcagtctactgcggataacacgaagtccaagtgcgttaagttgttcagagcgggcaaggcccggttggccttcacaggagaggtgcacaggttccctgccttagtcgcagcggttgcggccggtgaggatcccctgcctctcctgggttctgagacccgcatgttccatgtgctggacggtgtgctgaccatctacgatgacggggactcgtggacggagaccgcaccagcgttcgcagggagcgggtcccagttcgcccgtggtgcccatgcggcaggtgcctccgtggcgcaggcggtgcgcattgcggcggatctagacctatactccggtgggcctgtgcgtaggctccgggcttaaatttgatattgtcgtgcgcgggggtacctcagatcgcaggctcccgcgcgcccccgtatgggtaccccgcgcacgcacgcgcgttctatccctgatccacacatgggcctgcgcccgcctgagcgcgtgcacacgggctgcgcacacatgcgcctgcacgcacctacgcgcgcacaccgcacgcctgcgatacgcacgcacacgcgtttcaccctaggcaccattgctgaacgcgttcagaattttcccatcgattcacctccgatcttcacgccgccttaacatccgatgcggtagtctacacccatcgcagcaatgcaccgcagcgacaccgttacaacctcgtgcctaggcgtagcagcgtgcctatgatgggcgagggagaccaccggggtacctacacagggccggagggtcggcggggcaggaacgcacgctgagcgcgtgtgagcggcatctgtatcattttgctggacatgtaacacacgggtagcgcactggtgtactacctgagtaacacaccgatacacgatttggtacacgtacaacagatagaccgccgtattgcaaccatcctcttgacactggggggacaaggcccgcacactcactcctagaacggagtcattgtgggtagcgatacggacccttagatgggaacggactagctgggcttacagtgccatccgcttatctgcacttgatgttccaacgtagttggcgagtcgtagataggagttgacgacttaccacccggtaagtgttgacaggtagcttaggacgtgtcaccatagcttcgcagtagttagacaggtgggcttagacagacacttgacaggagtgagacagtaggctagtatgagtctcacatggttaagcaccgcagcgaatcgcagcgcttggcacatgaagaagaatgtattagcctattgacaacgacttgcgagtcag

SEQ ID NO: 23 - DNA, 43324 bp, Unknown
  Bacteriophage Xfas305
ggtcagcgccgcgcccaccgggaacacctgctccagcaggttgccggtcggctcaccgtcttccagctcggggacttggatgatcggcttgcggatggattccttgtcgatgttggcgtacgtcttcttcttgccttccgggccgcgctccacgtggaccacgttcagcagcaccggcttgcccagcagctggacgaagtgcttctcgtcggtgcgcaggcgggagaacatcttgaagtatgcggccttctccttggtcgagaggttgaggcgcaggctcaggcggaccggaatcttgacgccgccatccagttccttcggcggatgcttcttgccgatcagctcgaacacgatgatgacttcgttgttggtcttcttcttgccctcgaactcgctctcgtgttggcccacctcgtagtaggcgacgatgcgagcgccggtctgcccggcttcgggcggggtgtagtcgccgccaccggcggacgccacggactggtcctgacccttttcctgcacctgcttcagcagcttgtcgagactcatgctttggtttctccttattcaaacgacgggttgtgattaccgatgaagtccttgcggatttgcatgcggtactcggggaacaagacggcgaactcctcgggagggttgtgctcctccatcatgttgtcgcccatcttggtttcgcatggcacgccgagaggtagcggccacttgaaccaccactccatgtagacggaggcttcgagcatgcttgcatgcaggagcgctgccgcttccgtggcgatggatgctgcgctgtccacgtataccgcatcgtggacctgattcaccagcagggcttggccgagccagcgttccggttgggtgacgtacatgcggtagaaggcacgcagcgagacgtacatgctcgccttggcccactcgccgccagtcccctgcaccgggtagttcttgatttccgtgggcgagaacgactgcgccacgccgccacgtgaggcgggcttggttgcgatgaacttgggagacggggactcgctgaaggagtacatcttcccgtccggcgtggtgaagtgcgagcggcccagctgacaggtcaggcccggcacgtccgggtgctgcacgaaccggccagtcgtaacgcggttggccttgatgacctccatcatgtggtcgatgtactcgcccagctccgggtaacgctcggcctcggcgcgcaccagcttctccacttcctcctcggtcatgcccgtggtcgctgcgatcttcgcaacgcctgcgccgtacgcacgctggaaggagaagaccttcgcgttgcctcgcatcttcttccacttgctgtgctccgggtgggtctcgtccttcgctgccttcaggatgtaggcgtagtccttgccttcggccgcaccccatgcctgctctgcgcgcagaacgtgcatgtcgagaccggccttcaggtcttcgatcagctgtcggcactcggtgaggatcgcctgcacgtagatttccagcgacgtgaagtccgactggatgatcttgccaccagcgtggcggctgatgaacgcgcgcttgatctggctgcccttctccttgccggtctcctcgtcgtactcgcccttgctcacgttctgcaagttcgggtcgctcgacgacaagcggccggtcacggtgttggtcatgttgagcttgtggtggatgataccgtccggcccaaccagcgtgagcattcccttctgctccccggtcttctcgtccgtcgtgatgaagtacgtggacaagtccttgtggatgtcggcgcgcttggcgagcgccttcaggaacgggatgtcacgagcgcccagctcctcgatcacttccgctgcggtggagtacacgcccggatcggacttgctctcccagcgctcgctgccctcggtgtatccggggaacacgaacaccatgtcctcgttgcggaacttgggcttggtcaggtcatcgaccttgaccttcttggtcttgcgctcgcccttgttcttgccaccagcgaacaccgccacgtcggggaacttctcggcgatgccgtcgaaggcttgcagctcgttggcgttgtactcgccgatgctccgagtggtgccgtccaccaacacgtagtgcagctcgtccttctggacgtactgctgcttgccggtttcgggaaccagcacgggaaccttcgccacgtacttgatggggccgccgaagatcagcgcgctcttgtggaagcggctgttccagttgaaggtcaagccctcgggcagctcggggatgtaggactccagctctgcggtggcgtcggcaagctcctgctccagcttcttcgcatgctccagtgcccacggcttgtccacgaacatgccgttgtactcggcctcgatggtgaagcacagcgcgcccatgttgagcagcgccgagcgcaggccgttgcgtgcccggaaggcatcgagctgtccgaggaacatcttctcggtgttgccgatgtcgcccacgtcgtcggtgtcgttggtgccgacgaggtagtccatcagcagggtcttgtcgatgtcgcacgtgtccacccctgcattccacagggacttcaccgcgtcgtccttcaggttgccgccgtacctcggggccacctcgtccatcgcgcacatgtggaactcttgggtcatgccgtgcagcaggtactcggcaagctggcagtcccacaccatgccgccacggtcgatgaactcgatccatgccatgcgattctgcgggccttggcagatggcgtgcaggatgtcgaacttgatgttgaagccgacgaggtactgcgcaccgtagcacagctccttcagccaaccatccggcgcaccgccgacgtagttgttgtcctcgtcacgcccggtggtgaagtaccggccgctgttcttggcgtcgcccttgcgcttgtggccgatggcgacgatgcggttgaggttgtagaacggattcgccttgcgcttcagcgtggcgcggatcgtggtctccaagtcgaaggacacgtaactcatgcttcctccttcacggcgaagcggtgcgcatggcaccagaccttcttgccgcagtcgtcgatgacctgcacgtatgcgggccatgtgaagttgatgtcgtgcgcctcgggctggtagccctgcaccgtgtactccttgccggtggtgaacaggtagccacgcgagcctcgacacactacggtgtcgcctgctttcatggcgtcttgcctcccggcttggtgatccacacggtgacgcacgggatcaggttgatgcaccagcgcaggttgtgcttgctgtaatgcacgcccatccacatgctgcccttgttcaccagccatccccacttccatcgggcgacgggagcatcttctgcactcgccttgtagatggcctcggcctgatcgctgcggtgggtgtagacacgcacgccgttcggcaggtccacaaaccacaggcgcttctgttcgttccaacgaatcttcatgcttcctcctcgtagaagcgggcacgctctgcgtcgaacatcacctcggcacgaggatcacgcttaccgcctgcgcggtgcagcttgttcttcggcgtgccgatgtagcggaagcgatccattgcgggatcgttgagcttgccgcccatgatgatgaagtcgcacgcgccctgcttgcccgtcttgctgtccttgagtgcggactgcggcgggaactggacaccctcgccctcggcgctgatctgcgaagtcgccacgcccacggcgtcgtacttcacacaccagttgcgcgcggcttggtacatggcttcgagcatctgatcggtacgctgcccgccgttggtcatgccgccggtgaaggtgatgttgtcgatcatgtcgaagatgatgaagccggggttggtctgcttgatgatcgcctcgacctcgcctgaggtgaagccgtggatgtcgtagaactgcatgcggtggatgtcgccacccatcgcttcctcgatccgcttgcggatgctgccgtccttcgcccactccaccatttcggggatcgttgcgttgagcagggactgataccagcgctgcttgattcgcttgcccggcccctcgttgttgagccagattccggtgcgcttctggtcaggccacaccgtgtccagctgcgggagccagaacgtggactcgctggtcaggaaagtggtcttgcctgcatcggggcgcatggcgtagatgccgaagtcgccgccgcgcatcgggcgcaggttgcggctcaggctgggcagtcggaagtggattccgatgtcgccctcgtccatcgccatcagctcctcgggcgtctcctgcaccagaggcagccgggccttgcggtccatgcgttcggtgatgccctcggccagagcggacagctcgtcacgcagagagaactcagcgccgccattccactgcacgatcttgctgacggcggacgtggcaagctccagctccagcagcttttcgatcatgccctgctccgcctcgggcgggacagactcgcgcatcgcacgcagctgcaacttcagcagggacttcttgtcgtccggcagctgcttgaacttgaactccatcgcccaaccatcgaacacgtcgtgcggcagagccttggtctcggggaactccttgtagtacgcgcgcagtgcatccagcatcagcacggtcagctcgtccagcccttcgcgcggagcgttcgggaccagccggtcgaacttgcccttgtcgctgcacaatcgcagcagtgtcaagtctaatgacatagcttctcctcaatgtagtcggtcggataatacttcgggtcacgtggtgacgtgatgttccgatagtccaagccgaacgcacggaggcgcgcggcaatttgctttgcggcatcctgaccgggattgctcccgtccgatctgcccttgtcgtcgtcgagccacgtcgctacacgttggcctcgctcaatcagctgcatcaacaccttgttgtgcagcttggtgccgagcaacgaccacgcttctgttaccagtcccaccttgtatgcggagagcgggtcttcgcatagaacgatggtgtctcccttgcccacgccgaagcgtgcgacgagtccgtctttcgggacatcaggagtcagccacttcggttgcctcgtagaggaccgggctgtccagtacacagggcggtcgccttccatgatgggtagtaccacgcgcccgatgtccgggcaccagtacaggccgagttccccgatcatgcgaagcgagaggcccatcttgtagaaccacaccttgtcacgcagcggccactcggttgtgtcatagacacgtggctctggcaactcaacagttgcgcgcactctgcgctcgctggtttgctcggcatgggttcgtactagcttggcttctaagctctcgtgctcacgcttgaatcctgtgccaccgcacctgaaacagtatgcggtggacttgtcgtgcgagcgagtgatgagcaacgagtttccctcaccacacgcatggttgatccgagtgcgggtgccgaccttcagtcgttccgcatgcggcagccagtcgctgtcaggtagttcgttgctcatcttgtcctcgctaggtcagtggctccagatcgaacccggagttgcgaaggcgacctcgccgttgctggtgttgaccagctgacggttgcccttcttgtcgttgacgttggtgacgagcaagtaggtgtcgccgtccaccacggtgccatcaccggtggcgatgcagcggtagttgtagccgaccttcaggtcacgcccggcgacgaacgccgtgcggctgggtgcggtgctcggggcggaagcgttcattcggcaccgccttcgccgcccgctgcggccgccgccttggctgcgtcgatgtcggcctgcgccttctcgatgtcctcgctggtgaacagcagggcggtggcgtcgatcaggtggaactcggcgtcgaagccctcgccgtgctcgaccttcagctgcacgacacccttctcgttcttcttggtggccgacacggtgccggacaggacgcgcttgttcaaggcacgaccgtagacgtaggccacggcgtcgcctgccttcagcgcttcgatggcggcctcgttggcgatgctcgcttcgatggcggcgatcttctcgtcgatcttgctcaccttctccagcgccttggcccggtcttcgcgcagctcgttcagcttgacttcggcgtgcgagaactgggtctgctgggcggtgttggtatcgttcgacatgtggtgtatctcctttcattgacgggttgatgggtggtccgtaacgtggtcccttccggcacgcaatcagtgcgagatttactggaagatcagctcgctgttgtacccgccgccgccattgtagaagcgacgacgcagcacgctctcctcgccgagcaccagcaggcggtccacgatggcgcggatggcgcccatgtactggtccaccagctcgctctgcaagttcatgtcgaagcggatcacggtcaccgcctcgtcatccagtgcgccggtatccttgcggacgtacaggccacgggcattggtcatcgtcgcaccgccgatcagcttgacggcggcggcaatctccggctgcacgttgagcagtcggctgtcaggcacggtcacctcgacccagcttcccatgcgcaggctcatgctgcacctgccagtgcggcctgcacgttcggctgcaacgatgcaccggcacgcagctcggctgcccggcgcttgatcttggtgcggaggcggcggcgttccttgttgttcgcgcccatcgcatcggccgctgccttcatcgcgttgttgcccacgttgcgggtctggcccggcccgcacatgtagtcccggcccagcatcttgcgcagcagcgggttctcgatgggaatcagcggcaccgagacgtgcaggtagcgggaggtgtccggcgcaggaggcggcgtgttgtcgtcatcgtgctgcggcttgatggcgttgaccaccttgtccttgatgtacttggcggcgctcttgatcttgtcgaggaaacccatcagcgtttctccttgttgtggaagtggttgaactccagctcatgccacacgtagtacgtggtgccgagcgggtcggtcattgcctgctcgttgcgcagcgtgcagtagtcgttggcctcgtcgaggttgtcgtaggtgcggacccacaacccatcgggagttgcctcgccggtgcggaaccggcacagcctaccgtcatcgtcatggtactggccgacgacgatccacggaccacgcccgacgacccagtagagcaggatcaggaggcgcaggccgagcttacgcatcggcgtagaccgcttcgatgaagtagcccgacgggttgcccttgctgcgcttgtcgccgagggtgtccagcacttcgcgggcggcggcacgggtcgggaacagcaggttgctctcgtcgttgttctcctcgtcgccgtcgatgcggacggtcgcgccgtcctcgacggagttgtagcagctgatgtagtcgccgtcgtacttgatgcgccaacccagcacgggctgcacgctgcgcaccttgtcgccgaactcgccgacgccgtagtcgaagtgcggggactcgaaggattccagctcgccgatggcagcacgggcggcggcgcgcttgtcccagaccaccacggttttcgggtaggtgccgtcacgcagtgcatccgacaggctatcggtcgcgccaggcttgatggtggacaggatttcctgcacttcctcggtggtggccgggcgggcaccggtcaggttcgggttggcgacgacgccgacgatggtgttggtgcccttggcacgggtgatgccgaagtaggtcttgctcatggttgattctcctcattgacgggtgggatttcgtactcctcgacatcagcgatgcggtcgtttgtcttgaccagcgccgcccatgcctcggcctcttctcgatcctcgaacgtccatccattgggtgcgccgaggtgctgaccgctgtaccactgcgcgcctgtcttcaggctcgtcatgtggacgcggtaacgcaggctgaccttacgcataccagcgctctacgctgtgctcgtaggtcacgaactctttccactggcgtggctgcgcagccagttgcatcggcgaacgcttgccgttatgtcggcgcttgaagatgacggggatcatgcaatgtgccctccttgttgggcgtgattccaaagctgcgccctcgttggaaggcgcagcggtagatcacgtgcggttcgggtgccacttcacgcggtagcggtggcggtcagcgatgggaacgtgggtgttgatggcgaggcgtgcgccctcggcggacgggaacgtgtcgcgcagccagtggctttcgctgcggccccagccgagcgggcggttcaccttgcggaagtattccaccacgtagtagccacggtcacgctccgggccgcccggcgtggtgctcggcacgacacggtagctgttcggattggtcccgtagcgcttgatcctcgcacgcatctggcgatacgcctcgttgcgggaggtgtacgtcgagttggcgatctgcccattgccaacgcagctcacccagctattcccgtgttcgaggtactgcacgatccacttcttcggctgggcttccggcgtcagggccacacggcgtgcagtctggtcgtccatcagcacgtcgggcagcggtcggcgcggcaggttgtccggcatcgggatgtccgagaggcgcatgcgcccggtcacggtgcgcggcggcggaatgggtgcgcccttcatcagactggcgagcaccagcacctccagcaggccgaggtcggcgtccagcatggatttgccgccactcgggcgggccatcggctgggtcagcagctcgccacggcgcacaccggccacgcctgccgggatcagctcgtggaagatcggcttgccgttgaaagtctccacctcggtgcggaaccgtgcgcccatcttgtgcggcagatcacgcagcaccgcatacagcggcgagctgccgccgacgtggctgaagcggaacgtgcccagcagctcggcctgttccttggtcagcaccagcacgtactggctgccgtcattggtcttcatggtagtcatgcgttcacgctctccttggtcagttcgtcgatcaggaaggtcagcaggcggcgacggctccggccatactcgctgtcctcgtcgtacatgttgccgttgtacagggcgcactcgtccaccgcgtcgaagtaggcggcagcggctgcatcgggatcgtcccagtccaccgtgtccatttcgttgtcggaacggtactcgtcgatcatgtcgtcatcttcgcccgacgccgggaccgggtacgtgctgcacccgctccactccggccactcccggtagagctgcgtgcggaggtccacggcagcgcccacctcgtcttgggtgtagtcgtcacgatagcggatgtcttgcatctggtcggcgagcttctcgcacagggcttcgccaagcgagttctcgtcgtcgatgtccgcacgggcggcgatggccgcagcgaggaggagcgcaacaacgcgctccccgtagattcccgtgaggcggctcatgccttcacctcggcgctcttgcgcttggcggcgggcttcggcaccttgtgcgcggcttcgatcacggcgcgctcctcctcggacggagtatagccgccctcgacggccttctccagacggcccagcagcttgtgcaggtccgcagcgaagctgaactcctcggcgggcttctcggtcttgaagtcgtgccacatcttggcggcggcgcgctccagcatggcggccagctcctcgccctccagccgcttgctcttggcgtacttcatcggcatggcggccttggtctccttgtcgtcgttcggagccatcgggccgaactcggacaggtacaggcgcagcgcctcgtgcttcatgccgttgcccacggcaaggcacaggtcggacgccagagtcacgtcgccgtggacgtgggcatggttgatgacggcgatggcggtctgctggatcgtgtccaccagcttggtgcgcgccgtattgatggccttgatgctcttgcggatgttggccgcattggtctcgatgttcatggtctggtccactcggttatcgtgccagtcgcacgcagatacgccctccgcaagggaaggcgcatcgtcatacgtcctgttacaggtaggctcggcgatccgccgcatgattcgcccttgccgtgccgctattcccagcgacaaacacagatcgctttccggcggttccgtggcgtgcctcgtagcgttctgcgtcgcgcttgcgctgggcgagcttgcggtcatactccgtcgtccgcaggtccatcacgcttgcagtccgggtgaactggcaaaagcggcgcttggtgcgggtgcgttcgaggttagcgttgccgtgcatagtggtgcctccattggcactgtgagaaagcgaaaacatacagattgaagcggcttctacaggccgggctgcaatccctcctgtaagccttgcagtagtcaacggaacaacgcctatcgtgggcgcacactggtgcggagctaccgctatccatcgaaccgtgaagccgcttcaatctgtatgccccttcgggttgtcaaccttactccgggcatacagtgccatagtcaccgtgtcccgtaggcttgcacgtatccctccagtgagggtgcccggaactgccccgagctatgaccggcttcctgtattccgacaggttgcttcccgtggccgactctcacggcagatgggaaaccctacccgttagcagtaggtatagcggcaccagtgttgcaagtctggtggattctatgggcctttgacatcccagttcatccggttatccgctagtgctacgttgcagcttggcggtccacctagagctatcccattagctccgtcgcaggcttcccgttacaccctacccgttagcggtagtcttagctgatccttcagccttggtgcctatggtagcgcaccgtttgcatcttgtcaagccctattgtctcgactgggcgtcctgtcgccaccatcctaccatgtaagccggtagtccgctagtagtcgctccgcctttaggcttcctgaccgttggtgcatagtagcttactcttggcttcctgtcaagcccggtagggtagctcctcgcataatcctaccagtagctaaggccgcttgcccttgtcgtctgcccgaaggcgtcccagcggcttgctcatagcttgttactcgactgaccactagcttaccactatgctaaccgtctgtcaaccctcttggctgtcaatgcttgccgtgtggcttgcatcggcgaccgcagggaggatgctagtctatagctaggctatctgtcaaccccttggttcacttccggctaaagaccgatacgattttcaggacatgccctctgtcgtatgtgtaccaaaaggaaaacgatacagatgccgccctcccgtccctcagtgcgtccgcatcatagcccggtagggttgcccctgtcaagccctgcgtgcgccctgtaggcccgctggtggccccgtggcctgcatccaatgtgcggcccgtgcttccaacgtggagccatcatcgcacacccattctgaaccgtagctgaacaaatccagccgccttgcgtgagctgctgtcctgcctcaccagtgcgccggtgtactacctgaccagcacacctccacgcgagaggagagaggaacacgcgcccgcgtaacgcccacgcacgcgcacgcacaggcacccacaggcgcacgcgcgcatacacccgcacgcacccacgcgcgtcacgcgggagggcgcatgggggcgcacacgcgagctttgattggagtggcccccgcgcaattctaaatcaaaatttggtccagctcccgatcagcccgtcttaagcctaacgatgggcgcagcggagtacatgtcgatagcgcacgcggcagccacggccttagccgcagacttgctcacatggtacgctccacgagcaatacccgcgccgctgccaatgaagatcggagcgtcatcaggccaagacttcttaccgctaacgactgtcgcctgtccgtccttgatgataagcacggtggagctaccactgaccagcggctcgatggcttctccgcctttgagggcggctacaacggagcggaggacgtgaatctcaccggctacggcgcagaagaccggaccctccggggtttggacccggagagccttggtcatcgtgcccttcatgtcgtccgcagtgacttggctgtcggcatacaggtgcttgccgtcccacacaatggtcgtcatgcctacttctccaccttgcagcgccaaccgcaggcttgcttgtagccgtcgtaccacgcacgcagggcgcgcttgtccacgttgcagagcttaacgtcgaactctcggtcgatagcgagcttcgctacgtcggagtttgacggattctccttggtgaggtacgttacggcgcaatcttcaaggtactgcgcgggcggagccggtatcgtgacgcaggaggtcagcgacatcagcaggaacaggctcgtcagcccactcaggactgcgggcaagggcttgatcgagcgcggcatgcgcgttctccttctcgattactacggttttgagttccttagccgcagtggtagcggccgaggcgttgcccgacgcctgctggtagtcctgctggacgttggctcgggagttgcggaggtgcagcgagtacgcggacaggaggattacggccgcaagcagcagccctccgatcagcaactcgattttacggaagatagacataaggtccgtccttcaggcacatggcctgctcctcgtaccgtcgggtcacaaggccgttcagtaccatcttgttggcgtaaatccaccggggatactggttgcagctcccacggcggtctccggcgttgaccttgcgaagcagggtcgatgcccggagattcggttcacccacgttgaagacgaaggacaccatcgcgtcgtactccccttgcttcaggggaacgcgcacgttgcgctggacagcccgctccgccacgcggaggtcttcggcataccactggtcgcactgctcgtgcgtggcccgcatgccgcgatacacgcccttggtatggccccggcagatggtccacggcgcgccgccagtggccgggtcagggtaggccaccagccggtagccttcatgggaagcgatctgctgcgccccgtcgagcgagaggtaggttgccccacctcccgccactgcgagggccagcagcgcggccatgacgcgcttgctgacgttcatggtcagccctccgggtccggctcgggttcggtcggcagcgcgccgccaccggggccggacgattccgcacgggactgggcagcggtgatggcagcctgcacgcgcgccacgtcggcgctgaacagggtgcccagctgggccgcagtctgcgggtgcttctcggcatgctcgaccagagccagcagctcacggacgaggtagttgccacggccgaacaggccggtgtagttggagaaatcggacttcagcatgttacctccggtaacggtcaaggatggatggacggcctgcacggatcggccctcgtcgggtcgccgccttcatgccggttggatcgttgatccagtcttggaactccttctgcgcttgcttctcgatggccttgttctggtccagtgcgagcttgctcacccagtgccggacgctaccctccagcgcgtcgattcggtcatcgtgcgcaaggctgccgcgttggctggtgatcttggcgagctggtggaacagagaatacaccgagcgcttgccgctgttggcgtgccgctgcgtgtactcgtgatccatttcgaccacgctctccagcacgacgagcgagccacgggcgatcacaggctccaaggttcctatgatgcgggcctccttgttgccggtcacgaactcctcgaccagcgagccgttccacttctcccgcaggattggcaggaacaccttggcgaaggcaccgtggcccatgttcttctcgatggagaggacgttcggcttgtacttggcagcgatttccgcgaggtggcgcaggccatccccgtcgtagccgcccggaaccgcgcccactgcgagcacgtacacggtggagttgaggaagccggtcactgcgaacgcggtctcgtctccattggcaccaccaccggcagggtcgatctgcatgtggacgccctgaagctccgcagtctccacggagatttcgtgcggggccatcatgatgaagccgatgccgctggactggaacgtgcgctggtgctgctgggacatgccgcgagtgatcgtcagcgggtagcgggttccgccgcccggaatcacgatcaggttctccgtcttcagcgggaagcgcatggcgtccatgagtctggtgttcagcatgtagttcagctggaacgaggacgggcctcggtccttcagcttcgcttgcagcttggcctcgtcgtaaatctgctcgtcggtcggctgcccctcgtcgcccatcgggccaccgccaaaggcgagggatgggtctgcttcgaggcgctgcacgatggacggggccagatgtgggccgtacgcctcacgctgtgccggggtcgggtagcggccgggccagatgcgaacgtcgaagccacgaccggggagcgtgttgtagatgctctcgctggtctgcggcgtgccgaggtacaggatgcgtgccgggattcccggacgaccagtacaaatggcggagaactccagcgtgatgttcagcagcagctcgcggttcgcggcagtgcggctgttcttgttggattctacgtcgtcggcgatcagaaggtccgcgcgcttgccgggcaggttgccggtgacgccgatgcacgccacggagggcgagcggtcgatgcccttcaggctgtgatgcacgtcgaacgcctcgaccgaggtgcggtcgcccgcgttcttgtcagggcgaaggcattcgagctgcggcacggtcaggatgatgcgctggatcagcgtcgccgtctcgttggcgttggtgccgcccgccgaaatcacgaggattcggtgctgcgggtcttggatcagctgccacacagcgaagatcgcggtgatcgtggtcttcgcctcgccgcgctgcgcctgcaccatcaggttgttcggcccgaattgcaggtagttggcgatgtcgtactgcatccacgtgggtgtgaagcccagcaccttcatgatgtcgcgcatgaagacggcgaagtgcgcgtagtgcttctggagcacagccagtttcttgcggcgcagctcggccgcctctgcggactcatgcgccattggctacgctccccggaaagttaacgatgttgtccagcgctgcttgcagctcggcctcctcggcctcggacacgtccttgttctccagcgtatcggccaactcgtcgagcgccttgttggcctcgcgcgtggcttggatgttgttgtccttcaggaacttgatcgcggcgttgatgtcggcagcggtacacagctcatcgttgcgcagccgctccttcaggaccgttgcgacgatgacgtgcagctcgccgagcgcgccttcacttgcgggattcgccattcttgtctcccatgatcttgcggtgttcgcgtgcgcgccagtagaactgtgcgatggcgtacaggatggcgagcgtggtgacgatggctgcgccataggtgctgatgaagttgaggtacaacgcccccgccgtgaggggcgaggtgcggacgacctcagaagccagtgacggcggggtcattatgttctcctataggttagggccagtcgtcgggattgccgacgagcttccattgcaggcggttgacgttgttcatgcctaccgcgatcaggtcgccggggattcccgaggcgatcacgtgttcggttgcgaagcgctcacgctgcgcgcgtacgcacaggttgctgccgttcttgtacgacaggagcacgtcgctctgcgtggcgaataccgctcgcttctcgtccatgcacaggcgcggggtggtagcaccggggatcaccatagtctgcatcgaagcagccaccgtgtcataccagtagaacttacacacgccgcccgccatgtacgccacgtgcgggcgcatggtctggtcaaaggccagtgcgatctgcgtgatccctgagtcggtcagcacggtgacgggggcaacgccgtcgcggtaaacgacgacgctgctgccatcactctcggcggtccacagcgcagcttggaggttgtccactgccgcgttgagagtcagcccgccctgctcgaagtcgatgagcgggcgggtgcgccggttctgctgctctacccagtcaccacgttggatgctttgggagacagtagggatcatggcgtgtagcgactccacgaaacgcgcatgcgcaggttcgccgtttccgatccggtcttcgtgacgcccggattgaagccgacttggaacggcacgcacgaactaaggcccatagccgcagtgatcgggccgggtggtacgttgttgatcgacatacggcacaccacatcgcggtagtacgtgccgggcacgtaggcaacgtactggatttgcagatcgctaaagctggacatgttacccggagggtactgatccgtgatcgcgccagtaccgtcgccggtgcctccgtagaagtagtagcagccccacacgtaatccgaccacgcaatagcagactgctcgttgagcgagccactgcgcccgagagcgatgggcttgcatgtcacagtggtgctgacgcccttaatcgtctcggtagtgacgaccggcgtagtgtccacatacatccgcagctcgtaggtgaccacgagaatctcgtccgacagcaccgtgatggtggtcgggttgccggaggagtccttgataagcgcgcgagtcgtaagcgggtaagtgccgttgttgctgttgtaccacttacccccaagctctgacaatacgccggtggcagtgcctgccgggaactggaactgcactcgtgcgtaggcgtagtacggagcggtggacgtgccgccagtctcgtaactggtgcggcccacctgcgctacctgtgcagcgagtgcggtgtcagtgaacgcaggctcggtgcttccgctaccaactgcaaggtagctgatgacgttgtagagtctctgcgcgtagccgctgccttggtcgccaaacgcgtccatgccggtatcggtaatcaggttgttctgccagtccgccactacttcgagcgagtcgagagacttgcccttgctgatagtgaacaggccggctactcccactttgttgtggatcatgcgaagctccatgagacgaagccgctccgaatcaaggcagtcgcgtcgagcggctgattgactacggggtgctgcttcagggtgaaagaatggaaggaactggacacccgagccgtctccgggtccgatgtgtagtccttacggatggaccggatgtcgaacgagacgaacgagcttccgtacagcgccgattctggatcggccgtgtagtcctgccgagagctgcgaagttcccagcccacgaacgacgaaccaataccggcggaatcaacaggcggtagcatgtcgatgttgctgtaaccagcgaaactgctggtaagcatcgcggcgtcgaactggtagaagctgtagagcttcgacgtaacgtagatgccctgctcctcgattcgcccggaccagtaggccacacggttcaacccgtccgtgaccttgatgctcaggaagtaggagctgtcgtcgttctgacccagcacgtacttgtggttccacttaacggtgtctacccacagcggcttgttctgcttgctgcggaatgcggacaggaccacctgcacgtacttcgtgtccttgggcgctgcgccctcggcgacagactggtgccatgcgccgttgctgccggaggaaaccatgttgccccagttgcgttgcagctcggtcccatcctccttgcggtagatgagcgacacgcgcgcaccggccttgcccttggagcttgcgccctgctggacctcggcggtgcatcggatgtagtcgttgaccttggcaggaatcagcgggttcagcaggtcgctgccacccgtcttgatgtcggcgaagcgcgcgctgtatacgccgctgtcggtatcgtagtcctggccggtgccaatcgaccagccttcgccgttcgacccgccgcccggcacccacgtgccgtcgtcgcctgcctcgaagtcgccgtttggcacgagggtttcctcgtccacgacttcagtgaaagccgcccacttgacgacgacttccttggtgatattgtccactcgtaccgcagcgcccggagggagcgtcgattcgatgacctccacggtgcagcggccgactgggttgttgatggacaggcgagactcgtaagcctcgcccgccgtgtacccttccagcacgcccgtcaccgacaggccatctgcaacctcgtccgccatcagcggtcggccgtacagcctgaagtgattagccatgcctactccttagccaagtcgcccgagagcaaccatgtgttggtgtcgccgtcgatgcacgttgcagtgacgacggagttggtgccgcgagttgcggcgatgcagccggctggtacttcgagagttacgcccgcgtcgccggtgatgaccaccgggcctgccttctgctgcacgctgaagtagctccccgaggcgagcttcgtctcaccgtcgccgacctcggggatcaggttgatgttgacggtgcagcccccggcgtacgtgcagcgcacgagtccgtactcggtagccttgtcggcgtagtaggtcggaccctctgccgggatgatcggcacccgcaggctcgtagcggtgatcggcgcaggcccggtgtagggcttggcgtaaccgcgcagcacggcgaaccagatgcttccctcagcgggaaccgtggcgaagcggatgaagctgggatcggttccgtcagcgagcgtgacctgatagtccacgtccggctgcatgccgataccgttgacgtacacgtcgtagaagcccgcgccggatacgtccgcgcccaccatgtcgaagtcggtgtcgtccgcctgatcgccagtccaagagccggaccagacgcgaggggctacggacacgataccgccagcggccagaagttcgaggacttccttgtaaatctcggtgatgatcttgttcaggtccaccaccacgccgacttgctggtcaatgctaagggtggcgatgttcaacgaatcgaacatttcctgaatgatcttcagcaactggtcgttgcttaggttaaggttggtcttgctgatgatgctaccgttaacgtagtcaacgagcatctgctgcaccggagtgctgcggtagatgtagagcttgcgcccagccgcgacggcaggctcaactcgcacggtcgaggagttctcatcctcggacagcacctccacggtgtgagaggtccggtcggtaagcagctgcgtttcctcgtccagaatgccgctcatcgcgtacacgtgggacgggtcgatgtagccgcccgtgaagctgatttgccagtcggtagtgacgccattggcgtcgaatacgtccgtcgcgtagcgcagctggggatcgggaactgccatgctgcctcctgtgtttgtcgtatgtgtaccaaaagtcgggccgtccttggcccgccagcgttattcctccagatgcgccgccgcgcccttcagcagcgggatcacgtacggcaggcgtccgcccggcagcacgtcggcaaggttctcgggacgcccgctcacgccctgcgcgaagtcgttgatgacccctagcgccggggcgaagctgccacctacgatttccttccggttgccgagctgaccgcccgcgagctgccgcacccagtccggggagccggtgtcggttgcgtgctcgtaccagccacccgccacacccgtccccacttccagcacgtcgccgaggaaggccgttgcgctgatgtagttcatggtgctgcggcccatcgccagaggcgacagtgcatcctcgatagcctgctcgcgctgctcctccggcaggaggacagcacgcgaagccacacgcagggcttgcagcggggcaaccacggccatcgccgaagcgatgataccggcagtaccccatgcgccgtacaggcccatgtagcgacccagctgcttctgctgtgcgaccagcgagaacgtgcggtgctggaacagcatcttcagccaaccgttgtgcgcccacttgccggtctcaccgatgaaggtgtcctgcaagatttggttcgtaccacggtcgatggcgttgtagaacgcgagccacgcctgccggtcgtgcaggttctccagaccacgcgggtccacagcctccagcttaccgtccgcgccccagcgcaccacctgatcctgcgtctgccgcaggcgagcaagcagcgtgtcgtcgaggcccatgtccttcagggcagtatcggcagccttgccgtcccgcaggaacttcacacccttggcgatcagcacctccgcgaagccgcgctgctgcacagccagtaccgcgcgctgtcccgagaggatgcggttggcgttggcagtgcgctgggccagagcggtcaggaagcctgcgcgctcggagccgtacagcgaagcctgcgtgtccatcgagttgaacatgtgcaggtcgtaacccgcaaggccgaagccgcgtccgctgatgaactcgaagccgccgaggatgctgttctccgggtcttcgccgcgcagcagcttgccgatttccgcacgcatgcgaggagcgattcggatggcttccgccacgccagcagcgccgacagccgggagaccgttggagtattccgccgcttggttgatgcccgctccgcccagctggatagccgaggtcagcagccgcgcattcgccagaacagtcggatcgcccgtgccgataacacggcccgtgaactcggacatcacctgatcgaacgcacgcagctccacgtcgttggcaccagtaacctgcatggccttgcgcagcaccgagataccggcgtcgcccatgatgccgtgcttcgccagagcgatgtcaccagccacacgacccgcgtacttgcggtagttgtccatcacgcggttgtccaagtagtccatcaggcggaactcgccctcggcatccttgtacttgcgcgtcacgtccaagtcgatacggctcttggtgtgcttcgcaccgccacgcgagtagcggcccatcaccttctggatttcctcctcgttgagcgacagtgcgcgcagggtgtcccgcagagtgtcagactggttatcggagaacaggttgtccggcgcacggttcatgcccgcagcccgctcctcgatccgctccagatacttgatgctcaggtcgtcgaggaacttgtccccgtacagctcgcccatcacatcgaactggtcacgcagtgcctgccggatgctctcacggcgcacgcgcccagccgcagcaatcttgccgcccagccaagtgcgggactcgtaaccggccacgtcaccatcgggaaggcgggaagaacccaccgtaccgacagcgcgctgctcggcagccatccggttgtagccttcgtccagcgccttcgccatctgcttgatggactcgtgcgcgtcggcaatctcgcggcccatatacatggtctcgcggtacagcttcacctcgtactcgaactcgctccgcatcttccagccggtggcgaagtccttgatcgcaccagccttgcgcacgtcggcgcgccacagccggtaggccgcttcccactgacgcgggcgcgaacccatgaacgactcgaagcgaccgcggcgatccatcgctgcggtgctatgccgaccagccgcgccttccgggttctccagcagggtgacggcgatcatgcgagcgaccggggactgcgacgacatgagcgtggtgctcgtcgcctccagcccgaacttctgcatgatggtggacagcttctccgcgtcgatggcatacttgccactgaagcgctcggcgcggccgatcacctcggcgacttggattcgggtggcgctgtcgctgatctgcttgtccagcccggtgcgctgcatgaaagccttgcgctcgcggttgttcttgaagatcgagttgaccagcatgccacgggtctgctgcgaggcagcctgcggagagcgaatctcctcacccaagttctcaccgaccacgttcatcaggcgctccaacgcagactcctgtccggtcaggcccagtacgcgggcgatcttgtccttcagccattcccacgcggtctgctgcgttgcgcccggaggagcgctgatgttgcgcagcactgcctgcacgtcgcggttggtcagaccatacgacaccagctcgtcggtgttggcgaggaagcccatgcgctgctgatccacccggccctgcatcgcctgagtcatcaggttgcggtccgcctcggacaggttggcattgacgtgcgtcagcagctcgtccatctgcgccttgaagttcgcatcctgccgcagcgagcggaaggttgcggcgtgtagcatttcgtgcagcaccacctcggcgttgtgcgcagagctacgcatcgccatcgcgttgagcgacgggttgtacccaccggccacgttcggctggttcgggaaccactgagccagctcggcgtcaggagcgatgcggacaccattcaaccgaccgctacgcttcagcgtgttggcgattgcacggaagtcttccggcacgttcttcgaggattcgaggtaacgcagaatgtcatcgggcgtgcccttgataccgctcgccttccacgcacgggtcagcagcggatcggccggagcgttccactccacgcgcccgcccacgttgtcggcgtagttgccggtgctcgggtccacgttctccacgtcacgcgccagtgcgccggtagcgttcgaggcagccgaggcttcctgcgccacgtccgggcgagcgaacaggcggaagtcgtccggtacgtcagccatgcctgcacgaatccagtccatcacctcggctcgcgcgagggagtgaatcttcgcgttgagcgccaccgggttgccctcgcccacctcagccacggcgcgtgcgcggaggtccgcattccactgctcgccgtacatggcggcgttgccggaggccaagtcgatggtggccttgtcgcggacagcagccgcgctacggataccgcgcaggttcatcgccgtgccgataccagccgagaaggcggcgtcggtcatgaagtcggcgacggtgcggttctcgcccatgcccaccagtgctgcatccgtgatgacggacgcggcggcgttctcggcgacactcgaagcgatgcccgcagccacacggccttcagcgaacagagccgcagagccgacgcccagcgcgcgcacaccaccggaggccaagccgccagtcgcccagttacccggatcggtcaggcccgccacgaggtcgtagccgaagctgccccagccggtctggttctccttgatgcgcatgctgtggcggcgcatgtagatgcgatccgtcacgtacgacagttcgtccggggagtatgccgcatcgcggatgtcctccagctcgtcggcggtgtagtaggacttctcccactgcttcgggtcgtacgtccaaccttccggcgtcacctcgcggtcacggctgagctggttggtcaaggcagcaccgatgccgctatcgaacgccgcgccccacttgtcgaggaacgacagcgagtcacggaacgcaacctcgtcccggtcggactgggtggcagcgatggcagcgcgagtgttgcgctcgttgctctgcgtgtcgatggcagagacttcttgtcgcacccaccacgggaccacctcgtcgctaccgcgcacggcctgcgccgcagccacgccctgctcggcggtgccaccggcgatgacgttctggcccatcgccagttcgcccagcccttcgcgcaccttgccgatgtactccttcgtcgcacgggcgagaccgctgcccgcgccttcgatggcatccccacgccatgctgcggggatgctcgccccgctccacgtctgcgtggtcatgtttcctgcaccggcccaagcggcactgatgccgccctgactggccgcgccctgcggagccacagccggggcagcctcgccgcccagtacagccggagcgtacgccgcattcttcggtccccagttggcacggttggtgccgccgtggtagatgcggagtgcggtcgtaacgtcgcccttggcaagctgcatgttctcgcgcatgatgtgcgcgtacatttcgaggttgtcttggaagttgcgcacgtcgtacttcttgcccgtgcgcgcttcgatgacggcctgcgtctgcggcatgacttggaagtcaccgcgagcgcccgcctcggaagtgatgatgccctgtgcattcttctgtgcgcgcccgttgccggattccacgcgccactgtccacgcacaaccgactccggcactcccgcgtaagcggcagccgcagcgatctgctggtcttgggtcagccccgaaagatcgagtgccattgtctaattctccttagagtttgggttggatggaaatgctctgctggatgctaccgtccggcatgcggacgtagccttgcggcaccgggaactcggtgcgggtcgcagccttgcggcggcgttcgtactcggccttgatgtcagcgccagtgacggcgacgaccttccagcccctctcgccaaccgtgttgacgtacagcaccggctctccggtctcgctatcacgcatgcggaacacgtcggccttcaggctcttgctcggctccacgttgttggcgcggagggtggcgtcgattaccgcttcgattgcaggcccggtctccttggtgtccatgaagcccagccatgcgccgacgctgccgatgacgtgaccttcgtcgtcacgcccgttctcccagtaatacttgcccgcatcctcgccgccgtacttcagcttggcgagattgagcgcagcagtgataccttcggaggacgtgtcgagtagaccaccggactcgttgaccgcacgcacgattgcacgcgcagctgcggcccggccggagtcgcccagcttgttgccgaagtagccgaagtaggcggggttcgccttctgcaacacgtcagcaacgcgcgcctgcaacgcctcggattccttgcggctgcttgcactgaactcggtcgggtccgcggtggtgatttccccacgcgccacctcgtaggccagctcgaagttcacgccggattcctccagcgcttgcagcttgttgaacatcgtgttcacgccgtcgccgaagtacagggctgcggtggtcgcaccggacagcctaccctcgacgggattgccgttgatgtcgatgcgcttggcagtcgtgttcttcagcatgcgccactggttgtagaggtcgcgcgccgcgtcgttcggctgctcacgcaggaccgcacgtgccgtggtctggtactgatcggccacgcccttcagcacagcgccgcgtccagtgttggcgttccacaccagctgcgacatcgccactgcggggttcgtctgcaaggtctggttgaagccctgcaccacgttcgcctccagcagctccttgtccacgcccggcacgttgatcgtctgcgagtacgtgccatgccgccacgagtcgatggccgcccggatgtcctcctgctgcgccgccagcttcgcctgctcggtgttcgccgccttggcagcagccgcacgctcacgcagcaccgcttcctgcgcgcggatgtgcgcgcctgcggactgggccatcatgctcagacgctgggtgccggagtacagcggatcgtcgctgccggtcgcggccgcgtagctcatgttgagctggtcgatctgtgcctcggtcggcttagcaccgatgccctcggcagcgtacagcgacacgagcgccatctgctccgcagcctgcgggttgttgtccagccactcggacttgtactgcgcctgcttctgcttgacgtacgcctgcaactgcaaggcatcgtccgggtccagcgccgacagcacgccacgctgactgaggaacttcagcgtgtagaactcgccacggtcagcagcgccacgaacgaacgcggtcatcgccgccttgtagctctcgtccgtctggtaggcggaaggcgacagtccgtccagcaggctcacctgcgactggatcagcttctcggcctcggcttcatcgccgggtgccttgttgcccagcagcgccacgcgcttcgccatttcgttgtagctggtggagttgctgctgttgctcgcgtactgcgccttgaccagctcgctctgctgccacgccacgcgctccttggtgtgcaggtccatcagcggaccggcgcggtccatgaaggtcttctgcaacacggcgtctgcgtagccgttgcccgtcatctgagactgggcgagcctgttgaactcttgtgccatcgcttccggcggcagcttgcgcagctccggcatgcggtggatcaggtcttgctccatgtccgagaccgaacgcagcacgttgtagttctgcgcgccaatctcgtagttcgtgggaccgaacagcttgctgtaccacggctgctcggcagagatttcgtccatcgtctgcccgctgcgcgccgcaacgaagccatcccacatctgctgctgctccagcgccttgcggttcggggcagtaatctcgttcaagaactcggggagattgctgtccggcatcgtcatgccgccagtaccggcgaaccagtcactgccgctgcgtaccgcctgtagcggggccacgccaccaccttgcacaccggcctgcggaacggcagcggtcgcgccaagcgaaccgccaccgaccgtctcggtgctgaaggtgatcgtgcccggatcaccaatagccattaccatgcacctcctgaattgctcccgctaccgaaccagccgaggccggaggtagtcgtggagaagttgtcgtagttgttgccgaactgcgtggtgatcttcgcgcccgttccggtggatgcctgtcggcccgtgccgtcgttgtacccgaaggtgctggacgcccacgacttaccgccgcgctgcgaagtctgctgccacgccgacatgccattctggatgccggagtcgaagctcttgctcatgccttggaagtcaccgttctcggcctgccacgtgccaaccgcgaagtcggccacggcctcgcctgccatcggcccgccgaagtaggttgcgactgcaacgccaatcagcttgcccaagcggcgcttcatgcgcttcggctcgatgtgctcctgatagtcgaactggccgaacgtccggctgatgtccatacccttgtaggcgttcgccatgatctgcgccgtctgcgcagcgcctcggctcgacatgagctggatcgcgttctgctgcgtctcctgatccatttcggactgcaagcgcaccatcgtgtccatgaggtcggcggacgaaccaccgacacccacaaacccggactgcgccgcgagggcaccgcgcgccgcagcgagctggacctgcgtgttgaggcccgccccttgcttcgcgcgcagctcctccgacagctgctccatctggaagttgtactccttcgaggccgcgttcaccttcgcttggttgttgagcgtacgcatgtactccgagaagttccccttcgccacttcgagggcgttggtgttcttcgtctttgcctcagctgcgcgccagttcgctcgtgcaacccgcgtggtgttgttggcctgaaggatagtgtttacgctacccactagctaaccctccgcacgttgttgaaagtctgaccaacccacgacaggcccgtcactcggagcgggagccagtccttggagctgatcgtgtagctgcactcgcggacctcgcggcccacggggatcgacagctgcccggaatacaccggctgctgcccgaccaagttgtcgctgtcgccgaggatgcggccctcgaagtcgatgctgctctgcacccggttgcgcgtagcgaccacggccaccatgcctgcggtgttctgcacgtcggcggtgacgcggttgagtgccatgcggccgtccagaacagcctgtccgttctggtctcgcgggaacggattggtcggagtcaccgatgcgggactcaccacgccgaactccagcgccgcagggtcgaggtcatcgaactgcgacaggaactccgtgatgcgcgccagtggcgtgcccagcaggaagtagtcgctcgtcgcgttgaccacgacggagccatcggccacaccgttctccgtgcggttcgcgtacgcgatgcgagagtcgatgtacccgtgctcgtccagctcgcccttgaagtccagcacgtcggccaccacaccgcttgcgcggccggtgaacacgattcccgacttcttgaacacgctcacgccgaggatgttccccagcgatgccgcgtactggaacttgctccacgcctccagctgccgctgcccgttgttcttgttgtcctcgtagcggtacaggtagaacgtgctgggctgattgcgggtgcggaacagcaccacgttcggtgccgtcaccgtggcgatctgcaacggttctcccgtcagccagttgtcctgctcctcgctcagctcgtcggtcactgtctgctgcccgttgagggcacccacgcgcatctggtgcaggctcacgccctcgctaccgtactgcgagtagaagatgaagttgccggaggtctgagccttcgcgtcggtgctgtccttgtttgcgctcaccgcccggatcagcggagacttcggagtcagcagcgcatcgccgctcacgccgtactgctgccgctcaccgaagatgatgaggttgccgttgtagagcaccgcatgccgcagcacgtcgccctcggaaccgaacgcgaacatttccaccgggtcgtcgtcggcgatggtcacgacgcttccgcgccagaagtcgaggtagtccccgctcatgctcgcattgacgtagttcgcactgcctacgatcagccggtcttggaagacagacaacatcgtgatgggcttgtcgatgaaccacgggatcggagaggtgaggccgtcaccgaccttgcgctcgccgtatgcgggatggtccccgctcgccgggaagatgctggtgatgcctgcaccgttgcgagcgatgcacgcttgcccgttgtagatgtagagctgggcgacaaggttgtcgatggtgcaggtcacgcccgcagtctcgaaccagtccaccgagccgtagcccgaggtctcgccgctctccagctcagcgcgcaggtagtacgcctcgtccgcgcctgcgccgctcgggcgcacacgaatgatcttgccgtggaagtggtacttggtcgcgtaggtggcgtcggtgatttcctgccccgccgcgaagaacgtggtgccgtcgccttcatcgtccaccgtgatgtccacgaactggtcatcgtcgatgaggatggaacccttcaggtaggtcgaggacacgccctcgtcaacgagcaagtccgacaacttctcggcgatgtactcgggccgggtctgctcggcgctcgtgacgatccactcgttgactgcggagttgtactcgttcactcggtcgttgacgtgcttctggtacgccgggtccggctccgtgccgccgggcaggtagaacgggatgtcgctcgtgtcgagcgtgccggggtaggcagccgtcaccgtcttgtacgtcacctgcaacgtggtgccgtctgctcggtgcaaggtcacggtgtaggtggtgttgaacttgccggtgcgaatccacgcggcgagccggtgcaggttggtctcctcctgccagaggttggtgctggtcgcactcggacggttgtcgttgcccgcgatgtagacgtaactgccgatggctgcgagcgacgacgccccgcctgccaccaatgtgttgacccacgagctgttctcgtacgtgatcgggatgaactgctcgcccgtcttgtcgtacaggaacgcgaagctcgcggagccgagcgccgacgccttgcggcgatacagcagcgcgtactcgcggccctcctgcgtgaagtcgaacacgtccatgtcttgcagctcgacgcgcgctgcctcgctcagggccagaggcagccgggcagcgaagcgcgtaccgcgacgacgcacaagcccttcgacgggatcggacagaatgttgatctgctcggtcgtctgtcccggtcggcggcggtgcggcggcttgccgctcacgccctgcacgatgtccgggtaggttccgcctgcctttgccatgatgcctccttagccggggaatgtggtgtggctatgccacggatgcccgctgtaattgaacacgcgctgacgcagaacgtccacacttgcccgcgcatacagagggtttgccttgatctgccggatgtgctccgacttcaggttgatccagcttagctctcgctgttgcagaatcttctggtacttggtgttgtcgccgtcgaagtccgactggaagcgcagcacgctgtcgtcgcgcacgaacatctgcacctcgtaggggcagtcctcgaagtccagcagccgggccaccttgacggtgacggggccatcgaactcgtacttgttgcgtgcgacatcgtacagtcgtcggccgcgctgggccacccgccgcacgccgcagtgcggcaccgggtccaccttcagcacatcggtcgggaccatgatgtacttgctggtggcctgcggctggagcttcaaccactccacgttgaaccacagcgcgagcgacgaggtgtcgcgcagcacacggtccacgaggtcgagggcatcatccttgtacgggtgatcttcctccagagtgttgagcttcgtttcgcccatcgtcttcaggcaggcgttcactacgtccaacttggtgatgaacatgatgcctcctagggaacaaggcagagagagcgctgtgctctccctgccggtggatcagtcggccgcgagggtcacggcggacggggccagctcgaagtcctgcgagccgttctcgtcatccttcacgcgcacgacgatacgccacgcatcatcgcggccgaagacggcgacgacggtgcccagcgtaccggcctcgatgcccagcgacgcgatggcggcggtgatcgaaacgcggttggaaatctcgaaggggcggtcatagaccattgtgtcttactccttggtagagggcgcagtttgagttacccgagggattcagggactgcgcccggatggattaggcagccgcgtcgatgcgaccggccagttcgacgcggttgaagccgacggcgaacgacatccagctgtccacgaagaagcacttcgaggcgtcggaccaccacacgctcgactggagcggcagcgcttcggcgatcagcagcgcacgcggcgagaccgccacggccacgaggccggtgaagtcgccgtcgtagaagttgtcgttgtcctcgttcgacagcaggtggccttcgaccacgccgttcggcaggttctcgctcgacaggaccgggacgccccacgccttgaagaccgggatgccggtcagccggttgccgtcgctggtcaggtactcgccgttgacgatctgctcggcctgctggagggtgtagaacacggtcgggcggacgatcaggacgatgccatcgcgctgcggcttgaccttcttggtctcctccatttcggagaacagcttgccaatggcagcgtacagcttggccggatcgttctcgtcaccggcagcggcgagcacgacctgcgtggcaccgaagtggccctcgggcgcgcggccgttcttggtgaaggccgaggtggtcatggcggcagccttggcagcagcgatgctgatggtggcgtccacgaactcggcaatctcctgaccctgctcgacagcgatttccttgcgggtgtcgatgtcggtgaagatgtcgtccagctgccagatggagtggcgcgacagcagcatggtgtccacggtcacggacgccttgctgaagtccacctgcgtgccgtccggcgcgtcgccgcgcttcagcttctggagcttggtgcggccgatggccttcttggtcagggtgttggtgcccttgaccggcttgcgcgggaagaacttctccagcacggagctggaaacgaaggtgtgctccacgtcgccggtgaactgctccagaatcagggcgttctcgttgccctgctggttgatctggttcgggaggaccggaacggtcgggaagatggtgctcatgttgtagtgatgctcctaggttggttagtggatgacgcgagcgttcagagccttcagctcgtcggacttcgctgcaccgctgatgcccagcttgtccaccagcttgcggtactctgcacggtactgctcgcgggtgagcggggcgacgccctgcaacgactcggacacggcagccggattggtagcgggctgtccctgcacggagacgttcgggttcgaggacgcgaggctcagcagatgccgggccatcgcaacggcagccaagccgcccgaggacaatgcctcactggcctgcttcagctgatcggcgggcaggttggtgcgtgcgtactgctgcacggccttccagttcgcctcaccacccacggcctcgtggaccttggtgacggtttccttgtgcttcgcgtcggcggcagcagcgatgcgggacaccgagtccttcgccaatgcgaggatcgggcctgcgcccttggccttgtcgcccagcacttcgatcttggcttccagcaggtggaagttgcccttcgccgcttcggtcagctcacgactgttgatgtcgagacccagcgtgttgacgaagtagtcggccgcgatgttcaggccgttgtcgccgtagtccggcagctcggcaggagccggagcctgcggcgcgctcggtgccggggcttgcggttgcggagcgggttcgaggttcagcgcgttcgggtcggccgctgccggggctgcgggagcctgcggctgcgccggtgcggcgggctggttcggctggaccttgatcggatcgtcggcggcaggcggctggttgccgttgggctgcgcggtcgagacgatcacgtttgcgttggggccaccgcccggaggtgcgttctgactcattgggtctccatgttgttctggttgtcgatctgctgcgaggcgttctgcatggcgagctgctgctgctgtcgcatctgcatcatctgcccgaactcctcctcgctcagaacgtaggttgcgggatcaaggccgcgcgctgcggcaaggtcagcgatccacgcggacagcttcaggcggtcgagaatctgcggaggcagactcagcacgccgctgatgtcctgaccgaagcccagcagtcggtcacggtccccggtgcgcgagagcgcggcgaggccagtgatgatgacgggttcgatgtcggaaccggcgatgctcttgtcgatcagctccatgacccagtaggccacgggaacctgcacgtctacggcgatgcggctgtagccgccacccagtccaccttccagctcctcggccaccatgcggatttcttccgccgtcacgcgctcggcctgacgagtcaccgccgtctggagcaggaagcctgcgccaatgcggttgatgtagagctgctggatgttgaggttggtctgtagcgtgccttcgacgccggagctaatcagctcgatgtcgcccttctgtccggggattgccgcgccgttgggcgaggccacgaagtcttcgacggaagtctgaccagcagggttcaccagccaccggaactcggaggcgaggatcgctgcttggatggtcgcttcgctcaggagggacagcgcttggaagtcgccctcgtagtcttccacgaggccggtgccgtagtcgtcgcctgccgccaagtcccacgtcacagcgcggtagggcagcttctccagagtgtagctcgacgagaagttagcgggcagctgcacgttgtccagccacactgtctcctcgtacttcttgccgttgaacttcacccacttgtactcccagcagttgccatcgtcgtccggcttgaactccgggttgccgatgactgcgccgagtgctgcgggcttgatcgcggacttgtgaatcttctcgcggatgatgagttcgcacactgaaccttggcggtcgcgcttgacgacgtagttgcggaggttcagcacgcgcaccgtgtccttgtcgaacaccatgagcgcgttgcccagcacgatcagcatcttcagcaggtcgtacagtctggcgcggatggagcgcttgtccagctccagcgaggcttcctgctccagcttcgcaagctgggtctggattgccttcgggtccacaccggcctcgctcatcgtggcgcgggccttgcggttcgcctccagccggaagaacggccgggacggggcgaacagggacatcatcagcttgttggcgaggtggttcaccgcctgcgcgcccagcgactggaagccgtgggtcagcggttcggtgtcctgatcgcggttcttcttggggaacagcttcgggatggtccacgaagcgtagcgctccagccggtacaggataccgttgcgcttcccgtccagcttctcgtagcgctggcatgcagtggttgggtgcatcggattgtccatgctcacctcacaggaggtccgagccggaggttccggtcagacgcgattgggcggtcgggacgattcgctggtactgctgccgggtcgtacggcggcgaccgatcaggtcgtcggtcttcaggtcaaggtcggaggttccgagcgtaacgtccacggtttcgatgggcgcactcagcaacttctcggcgtactcgctcgcagcctgctgggcggcggcggtagccatctggtcggccattgcctgaatctggtagttggtctgttgggtctgaaggttggtctgacggtcgatggcagccgcttgcttcagggctgccttcttcgccgagccacctccgacgagggaacccataggctatctccttcgtttggtgagttgcggcgaaccatcctccagctcgaagccgaagcgttggtacagccgagtgattgcccgagaggatcgagctagtgctccgcctgtgactatggcatcgcaatcgttggtctcggccagatgctccagtgtggcgacgaccgccttgaaggagctacctttaccgatccgtagtaccaagtcctcagacaggactagcctgttcttagagtaccaaggtttcactacagagaataccagtaggtagctttcgtctatcactactgcatctaccatattctgtactaccatttccacagtgtactgtggatcgtcacagaggtagcttactgaggagctactatgctcactctcactcggggctaaagacagatacagggcagcgtctagcgccaccctgatccgctctctatcacccgtcgttggtgttcggattgctggactcaacggtgaatccctcctgcaaaatgcggagaactcgtgccattccgatctgcacacctgcctccaagggcgtggtgttggaattgacggagaggacggaacccgcctgtcgctgcacggcagccagttgcttcgggtccagtcggtagatgatcttggtttcggacatgaggtctcctctgtcgtatgtgtaccaaaagggtttgatgcctgccccggagggcgaggcaccctttgtcgtatgtgtaccgaaactccttcagctgaagaagtacggagaatcaatgacttgcgtgaggtcgaggtcgcccatcgggggcggctcggggaggaagccgtaggccgccctgaactcctccagcacgtcgtgccgggcgtacatgtccacgaagacctcccggatgatttcgtacaggcgggctgtgtcggcggcgtgggtgccgtagtcgtcgtggatcatggcgaaggcgtcgatgccttcggccttggcccggttgaccaccagcgtcaggtggctggcgtcgaggctgtgtacgaagttgggggcgatgccgttgcggtgccgggacttcttcacctcgtccgtgctgcggcgcacggagagcttcgcgttgccgcacagcttggtgttgatccggtgttcctcggtctcccagtacacctgcgtcaccgggaagccggacggcgtgatccacttgatgcggtcgtagccctcgcgcaggatcgccgtggacgccttctggagccacgccattgcgtcggctgccgccactaccgtgtcagctatggcgacgcccaggcgcttgctcaggaagcgtgcggccttgtcgtacagcttcttgtccagctcggggaacttgcccgccttcaggtagtcgctcacgatgaagtccgcccagctcgattggcgcgagccgtagggcagggtcatcaccgagcgcttcaccagcgagcgggtcaggccgtggtccagccacagcctgcggaacccttcctcgtcgtcctcctcggcttcaaggatcttggtcacgaggtccgccaccatctggtagatgtcattcggaagcggtgccgggatcaggttggtcgccttcccgcctgcactgtcgcgcagcatcgcggagaagttctgaagtccattgcaggaaccatccatgccgactgcgatgcggctctggaagcgatccccgaatacctgccactgctcgtactccaagcaccaagcgagaaattgcagcggcttgtctgcggtcttccactcgtcgttgttcaccgggtccgcagcaaacgccagaatctggtcgtgatgctcgaccacccacttcacacgatccggcagagacgccttgtcgtatccccatcggtttgctcctgtgatgcagaaccagtccttcgccgacttggtgagcaagggcttgccctcgccgaactccagcagcgccttctgcaagtccgaaccttgcggcgagacgccggtggtctgtacgtacttgcggccacggaagtccacgaagtagacgaagtagattgcttggtagtccacgaacttgcgcgccactcgcatggcgttgtagaagcgattgctcttgctgttgcgcaggcgctcgtcggtgtgccagtcggccacctcgcgcttccacttcttgaactcgcgctgctgggattcggacatgtcctccttggtcatgcccttctccaaccaatccggcttgcgcggcttgggcagctcggcctgcgaaatgatttcctccatgtcgtgaacctgcgccactgcggagacagcctccagcatacggcggttgatccgccacggcacgcgctgcaacgcattgaccgcagccatctcgttgcgcagctcggcgctacggtagtcgtcgcgggtctgagcgtaggtcttcaccatccacggatgcagcctgcgcatttcgttggtatggaatccgccgttgtccacgtccgtccagtccttcggcggctcgacgcacggcaggaagtacggggtgctctcgatgacgaactcgctgatctggtggatcaacttgcgcacgtcctcggtcaactccacgtgcagattggtcttggtcttgcggcggccaccggacaccacgacctcgttcatcacgccggtgtccaccatgcccatctgcgcaagctgatcgacgaggtagccgccgacctgatcgcgctgtgcttggccccactcgtggaactcgacgccgttcttcctgccctgcatcttcatcacggtcatgcggtgcgtctcgttgacgctcagcttgcggtccatgtcgttcatcaggtggtagaacagcgtcggctccgcgtcggcgaactgggtcagcaggtactcgtggtacacgttggtgcccacctgcttcaccacctcacgaccggcagccttatccttcttgccctgctcggcgatgcaagccgccaagcaaccacgtacggccacgaaggcgatagcctcgtaccattcggtggcttgttcttcggcggtgatggccttcccacgcttgtccttccgctccgggtcgtacttcgcccgcagaagtggcacgtgggcctgcgccctgccgatgcgcggcttgtcgatgtcagcccggatacgctccgcaagcggaagcacgaaccggcgatacaccgcctgagcgtaagggttgttcggcgcgccgccgttctcctcgttacgctcgatggccttgcgcatgcgctcttggccgaaagcataggtctccagttcgagttccgcttgggtgagcatgctacctccggttgtgtgcttcgtcgaggactcgcgccagcgcctcgttcacgacctcgcgcaggtgctcgttcgggaacagctgctgggcgtagtcgtcgaacgggatggtgatgctgatcccgatgctgcgggtgagttcttggtgggtgatgtcgatgcggacattgctactcatcggtccgcctccgccttgtcatgtcggattcccttgtagcgcggctcgcgcagcaggccgtacttgctcagggacatggattcgatttccacgatgtccccgatgcagggcagctggtccgcgctgtgcggcacgccgctaccgacttcctgctccttgccttcgccgaggtccacgaccaccgtccacacgtcgcgcccggtcttctctccggtgctcatgttgacgcgcagcactcgcaggtccagcgtcagggtgggcttgatcttgatgacttcacccttcgttcccttgtcgcccttggtccacgtgccgctcggcttgcgcaggatcagcccgtcgtacgggccgctctcgcacagcaggcgggcggcttccatcggcgacagctcctgatccacgaggaagccttgcgactccgcaaggaagaacggagccttgcattcctcgatcttgctgagcgtcgcgggcaagcggcccacgcggtcgaggtaggtcagcgggctgaagccctgctcccactcgccgatgctcacgaagtcgaagaccacgaagaacggttcggtgtactgcgtgccgtccttcttgcggaacatgccgctcacggtcggctggtcgatggtcgggtgccagtattcgccgaggtacactccgatgggagcgaacggcgcagcggccagtgcttccttgatgtggttcgcggacaccacttcctcgccggtgcggctgaagatcgtgatgtgctcggcggcgttggcggccttgaccaccacgcagttgcagccgtcgtacttgggctgtgcgaggtactcggtgcgcagcgcgtcgtcgctggggcgcagacgcttctgcaccttgtccagctcgacggccttgtgtacgatgtagggcttactcatcggccttggtctccttggtcgggaggttgttgcggacggtcagcccgccgacgttcgcggcgatgcggccggacatgaagtccgtgacgatctgaccgatccacagcttgcgcggcaccatgccgttgcggtagccttcccacgcatcggcgatgcgagcgtacagctcggccttgccttcgtcgttcaggccggggaacgcggtgttgaccgcatcctgcaacgcttcctcgtgaccgccattgccccaagcaacggcaccctcgtaggactggatcagacgctgggtgttggacttgtagttcattgtgtctccttgttgaatggaacgaaacctgcgagacccttcatcacgagtatgcagaacgcatcgtcagggtatgtgcgatgccagagtgagttcgcccactcggtatcgaaatgcttgcgggtacgatgctcctctaggaagcgcgcccactcggcctcatgtgggacgtaccgatgcacttggccgcagcgggcgcaggccatcagtcacccttgctgaaccagcggcggatgatgtactggcgcacgaagctgatgagcgtgaacgcaacgccgatggcgtgcgccgacagcagcgggtgctcgggatgccacagcagcggcagcaacgcgatgttcgcgcagtagttgatgctgtacccgatggcgatgttgacccacgcctccttgatggagcgcttcttactctgcgccacgggccttctcctcgcgcagctccagctccagcaggaacagctcgttgatgatgtggtgcgcccggtgccggatgccggtctcgggatcgaacagctcgccacggcagcgcgccgcgtcgtgccggtagctcgcatcctgatagcgctcctgcccattctcgacgtgctgccacgagtgggcggcgtacttgcgagcgccgaaggtgagggtgcggacgacctcggccagtgcgagcggcatgccttggtgcagcagccgtggctgctctttgccgccgtcgaacttcaggcccgctccgcgttcgctggtcggcggggtgcgttcgtcttcgttacggtagttcagttgctcaggcaagggaacctccctatgtgtggtggtgatgcctcctacgctcatcaggcgagtgaggaactgggccttgacgtaggactccttcatcaagccgtcgaagcggacattgatgtactcgttgcagatgctatgcaccacgccggacctaccgacgaggcccggagcggagccggtatagcgaacgcggtcgccacggcgaacatcggtaagtctcatgcgcttctccttatgcgggaacggtgatgtggcggcgctgctcgatgttggtcgtcagcttccgtccgcggctgtggccgccgcactgcgtgcattgcagcagcaggtaggtgccgacctgagtgcgggctggtgccttctgcgggatcatttcgttgtgcccgcacttgttgcagcggtgctcgctgccgtcggccttgtagtacaccgcgatgttcgggtgcctgctgtaccagccacgcagcttacggtactcggccttcatggacttcacgtcgatgatgttgtacgcctcgcactcgtcccatgcaccgggcaggttctgcatgcaggccacccacaggtcgaagccggggaagttcgcatggtcgtacttgcgcagctcgggaacgatgacgccggtggtgtactccagcttctgcgaggtgaacgcgaactcgtcgcggttcagcagcatcgggtcgatcacgctgaccggggagagcggcgggaagccgaggatggcgaggcgagccttcaccttgcgcaggtcgaacttcttgccgttgcgagcgagaacgaagtccgccgcgttgagcagggcgtggagaaccttggcctgcttgcggtcgttgaacacgtccttctcgcggcgctggtccacgtagatcgtggcatcatcgtcgtccagccactccgcagcgaacgacatgagggaccagtcgcgcttgatctgcttcgggctgaagttgttgttgaacatctgccatccccaaaactcgatggggaaggtctcgatgtcgaggcacagaatcttcggcccctgcttcggggcgtgcttcaggaatgtggtgaggttcacgggttctccttcttcattgctcgggccttacgcgctttcgcattgcgagcgatacgcttctcgtcctcggtcttgtgggtgggatgcagatagcccgtgatgttggtcatgtgctttcgcaggtagttcgcaagccctccgcagaaggcgaggatgtcccgcactccataacgtgggccattgttctcgaccttgcccagcagcgagttgcacccacgatggagtacgcctcgcactgcgccagtacgatgatcgtgatccagcaccgggtcgagcggtgccttcagtccgagctgaccgccgcacagtgcgcagcggttgccctgttctgctgcgagcttgacccgcaccagctttacctgagctgctgtcagtcgcttcattgcttcaatgcctccagcgcagcgcgcttctcgttgacatcctcggcgaggtcgtagaacgcctgcttcagcttgtcgccgaacacgtccagctggagcacgtccagcagcgtggcgtcccggtccgtccgcatccacagcagcaccgcctgctcggcgaagtaccgctgccacccgtcacccttcacctcggcgtacttaccgtacaccagcggcgcggcttcggcgttgctcttggtgccggacagcagcgcttccgccgtggccttgccaaccctcggcaggccggggatgaagtccgccgtgtcgcccatgagcatctgcatccagaaccacttgtgcccatactgcaagccgtccgcacccacgatgtcgtaggtgccgagcggcacgtccacgatgtggtagtcctcccacgtgatgtgggtgccgcagaacattcgcatgtccttgtcggcggtgtggatcacatgcagcacgttaccgtgcttggctgctccggtgctgacgaaggccatgccgtcgtccgcctcgcgggtcgtccagattttcggtgtgaagtgcgggccgtcgtacgtctccatccactcgcggaggaaggcccagttgttcggcttgcgtcctgactggcgctgcccctgatacggctgagtcgtagcagcgaggaacctgtcacccttcgatgacgcgccatgtgtgaggtgcatgacgacacgatccgctccgctgatatgcttcaggtgcgagacgcgggagagcacgttgcgtcgtgcatcccccgctgaacagttctcgctaccagcgcagaagtacgcagcgtagtccccgtccacgtgagcgatcacgttgcggttgtgctgtcgtacttccacgatgggcatcggggagcgctccgcagccgcagccatcagagcgctcaggtccatcaggcgacgcctgccatcgggtcgtccatgtcgaacggcggcttgtcgtcctcgtcgccctgcgcgttgtccacgtcaccgaccgccgcgtccagcgcatccacgccttccttggtgacggtgccgccgaccagcttggaggccgcgtagtcgtagcacggtagccccttgaagttcagcgccttggcgatttccagctggatggtgttcttgctgcgcgcctcggcgatgaccttgccggtcttctcgtccttgcgctccgggtactcgccttcgatgtagatgctgtcccacatttcggcgtcggcgaagtcccacacgaacgccttcagctc

SEQ ID NO: 24 - DNA, 43745 bp, Unknown
  Bacteriophage Xfas306
ttgacagtaagccgacagtgagctatgatgtaggcaagtgatcgagccaacggtaaggcggctggaccacctagcaagacaacgtaggcgctgccctagccggacacacgatagggcttgacaacgaaccaccggtgagctaacataggcaccacggtctgaggaccaccggcaatggaccgggcaggactaccgctaacgggtagggtgtaacgggaagcccttacgggtggaccgccaagctgcaacgtagcactagcggataaccggatgaactgggatgtaaaaggcccatagaatccaccagacttgcaacactggtgccgctttacctaagcctaacgcttagggcttcccatctgccgtgagagtcggccacgggaagtaacctactgccaaggtaggaagccggtcataagcgggtggtgagcctgctatcagcgggcatacccgttgtttcgtgaaaagtctctatgggacacacggtgacaatggcactgctagccggagtagggttgacagcccgaagggctagcagattgatgcgccctccctttgcgatgaccacgcaggcaaatccggtggttcagtgtgcgcccacgataggcgatgcaatggctctaatcgagaatgagggattgtccgactcgacggctttctgagggcgcatcaatctgttagttttcccaccagtgccaatggaggcacaacatgcatggctcgatccatgccaatctcgcccgcacccagcgtaagcggctcatctgccagttcacctggacggcaagcgtgatggacctgcgcaccacggagaatgaccgtaagcttgccgagcgcaagcgtcaagccgagtgctacgacgcccgccacggaatcgctggaatgcgatctgtgtttgctgtcgagggtaacagcgcgacgaaccggccgaaccacgccgctgacgggagggcttacctgtgatccggttcaagttctctcgccactacgtggaagctgcccgcgacagctacaatcgggccatcctgaagcatccggccggctctgtgtcggcgctctacatcctgccttgcggcgggcgctcgttcgacatccgactcgcttaatgcaagctactgggccttcgcaagagggcctagtgtcgtgcaatcggcacggacccaacctgaagggaaccaccatggacatgatcaccggaagcgctgacaccaagcgcgccatcaagtcgatcaagaccgcccgcaccaagctggtggaccagaatcaggccgctgagattgcggtcatcaaccatgcacacatcctcggcgacgttacgctcgcttccgatctgtgtctcgccgtgggcaacggcatgaagcatgaggccctgcgcctgtacctgtccgaattcggcccgatcgctcccaacgacgacaaggaaaccaaggcgagcgcgccgatgaagtttgccatgagcaagcgcgtcgagggcgaggaactggccgacatgctggaacgtgctgccgcgaaggcgtggttcgacttccagaccgaaaagcccgccgaggcgttctccttcgccgccgacctgcacaagctgctgggccgtctggaaatggccacggaacagggctatgagccgaccgccgaggaacaggccgtcatcaacgctgcccgcgccgtcccgaaggccgccaagaagcaggcgacggcgtaatgcggcccggtacccgcgtcatcggagccggacgtgctgatggatgaccagagcgcacgccacgtggcactgaccgcaacgcagaccggtctggtcaacaagcggcagaccaagggctggatcgtgcagttcaatctgcgccatggccgcatcgccctcgccaactgggcgcaggtgcgtgagctgcgtctgccgcagcgcagccgcaatgtagcgtaccgtgcactgaaggcgcgggccaagcgcagggcatcgccgaggacggctaccgtgtggtgcctgccggcactcccgatggcccggagaaggatcgcggcttctacaccgccgagatcttcaccaagcatgccctgcgtccgcatcagcttggctggaatacgtccggcgcacgtggtctcaccggcactttcccgactgcgcaggccgcagccaacgccatcgaccagcacgtcaaggacaccggcgcatcccgcagccgctatcgtgtgtacgtggcacaagaaccgcgcgtgatctaccgctgcgccttctaacgagggcgtagctttggaaccacgcccaacaggagggcaaattgcatgatccccgttacttacaagcgcatccgtcaggggaagcgcaagccgatccagctgtgcgagaacccgcgccagtggaaggagttcgtgacccatgagcacagcgtggagcgctggtatgcgtgaggtcagcctgtatcttgtggtgaaggcgctgccgctcgttaccgtgaagtatgtggctgttcccgattacatcctcggcggacagcgcaccagccacgaggcgtgcctccaggccatcgcgcaccaccgcctgcaccacgagaaggtgcccaccctctacaccatagaggaaatcgaaatcccacccgtcaacgaggagaaccaccatgcgtaagctgtacttcatcacgtccatcaaactcaccgcaaaggatggcgtcatcactggcgtggtcgccaacggtacgggccgcaagtccaccgccgaggaagtgaccacactggtcgagctgctgcgcttgaagggtgcgtcccctcccctgcccgatgcgctgtatgatgccacctatccgggtccgactcttgccttcgaccgctatgctgctgcccgtgccgaggcggcaaccctgaactcgttcggtggtctgttcgtctggtccgtcatcgagctgcctgagagcgtgcgtcagccggtgcgcaagccgctgggttggcggatcaagtacgacggcgggttcaccagctgctacaaccacccgaactacaccgcgaccgtgttcatcgacggcaactcgaagaacaccagcgaggacaacgtgctgtttgccacccgagacgccgcgctcacggccatcgagaaccacatcggtgacaagcgcagccgcaagaacccgcagggctactacatcgagccggtctatgcgtaagctctggctgcgcatctgtcgcccaatgtgctggatcacaggtcgtggtgtgtgggttgtcgtcggccagtctcatgacgacgacggtaagctgccgcggttccgctgtggcccggcttccaccgggttctcgctgacgttcgattctctcgacgcagccaacgactactgctctccgcgcaactggaagtctgacaccgacccgctcggcaccacgagatacgtgtggcacagaacggagttcaaccacttcggacacaggagaaagtgaccatgggattcctcgactctatcaagaagggcgcgctctacatcaaggacaaggtggtcaagtgtatcatgcccaagcgcgacgacgatgacaccaccccgctccctccggtggacacgagcaactacctgcacgtcagcctcccgctgatccccatcgacaacccgatcctgcgcaagtgtctggggcaggactacttccccgtgcagaaggggcagggtcagacctgtatcgtcggcaacaaccagctgaagcgcgtggccgatagcctcggtgcctctaacaaggaacgtcgcaagctgcgcacccggatgaagccgcgcgccgccgagctgcgtgccggttgttcgttgcagccgaacgtgcaggccgcactggcaggtgcagcatgagcctgcgcatgggatgttgggtctgtgtgaccgtgcccgacagccgactcctcaacgtgcagccggagtgtgccgccgccgtcaagctgatcggtggtgcgacgatgaccaattgtcgtggcctgtacgtccgcaaggatacctgtgcactggatgacgaggcggtgacctgtatccgcttcgacatgaacttgcagagcgagctggtggaccagtacatgagcgccatccgcgccatcgtggaccgcctgctggtgctcggcgaggagagtgtgctgcgtcgccgcttctacaatggcggcggtgggtacaacagcgagttgatcttccagtaatcccgcactgaactgtgccgactggcccacgttacgggccaccaaccaacccgtcaatgaaaggagatacactgcatgtcgaacgaatgtaacgccgccgccgaagccaccaccgtcagctgttacgaagccaagcgcgccgagctgctggaagacatcgccaaggcgcaggccaaggtcgatggcctgtgtgagaagtgtgccaagctggatgccgtcgaagccaacagcgccgccatcgaatgtctgtccgctggtgacgccgtgtcctacgtcttcggccgtgctctgaacaagcgtgtgctgtcgggcgtcgtggtcgccaccggcctcaacgacaagggcgtgctgcaactgaaggtgcagaccggcgaaggtctggatgccgagctgaacctgatcgacagcagcgccctgctgatgtcggccgaggaagtgctcaaggcgcaggaagaaatcgacaaggccatcgccgaagcgcagctggctgccgctgccaaggcgcagggcgaaggcggtcagtcgtgagccggggcagcaccagcccggcgtgtccgccgaccagcgcgccgagccgcagccagtgtaccgcaggccgtgacctgaaggtcggcttcaactaccgggccatcagctcctgtgcgggtgaagtgatcgacggcgacacctacctgctggtcaccaacgtgaccgacaagctcggcaatcgtcagctggtcaacaccagcaccggcgaggtgtccttcgccacgcccggctcctgttggagctactgatccgacgaggatagcatgagcgaaaccctccccgagaacgacctcctaccatgtgccgagcgccggcctgttggtggccgaacccgactcgcccaagagtgcggggagggtacgtttttgctaattactcgtgagcatgacaagtccaccgcaccctgttttaggtgcggtggcacaggattcaagcgtgagcacgagagtaacgaggccaagtgtgcgagaatccacgccgagcaaacgagcgagcgcagactgcgcgcaactgttgagttgccagagccacgggtatacgacacccgcgagtggccggtcgacgctaaggtgtggttcttcaagacgggactctcgcttcagatgatcgagaagctgcggctgtactggtgcccaagcatcgggcgggtggtactaccgatgactgaaggcgacaacgtggtatactggacagccccttcggcaacgagacagccgaagtggctaacacctgacgttccgaaagacggacttgacgcacgctacggcgtgggcacaggtgacaccatcgtactgtgcgaagacccgctcagtggatacaaggtgggactggtaaccgaagcgtggtcgttgctcggcacgaagctgcacaactcagtgttgaagcagctgactgatcgaggccaacgtgtagcgacgtggctcgatgacgacagaggtagaagcaacggtagcaatcgcggccaagacaccgcgcgagtaatcgctgcgcgtctacgtgcgtttggtctggtctacaggaacatcacgtcaccacgtgacccgaagcattacacaaccgactacatcaaggagaagctgcaatgagcaaacccatcgtgcgctaccggcgcgctatcatcccgcctgtcgttggcttccgtgccacgctcggcggcgtgcttgcgcatccgaacctcggcgactgcgacatcgtgcacacctcgacggtgctgtacgtgacagacggcgggcgcaagttcgagacacgcaacacccggtatcaccagctcgattcaaagtacgaacccgaaggagaacctgatgagtcttgacaccacgctgctgcggttgtgcaccaaccgtggcaagttcgaccggctggtacccagcgcaccacgtgatgggctggacgagctgaccgtgctgatgctcgatgcgttgcgtgcgtactacaaggagttcccggacacgaaggacttgccgttcgatgtgttcgatggctgggccatggagttcaagtggaagacgcagcccgacgacaagaagtccctgctgaaagttctgctgaagcagatgcgcgagccggtcccgcccgaggcagagcagggcatgatcgagaagctgttggagttggagcttgccaccactgcggtcagcaagatcgtgcagtggaatggtggcgctgagttcagcctgcgcgacgagcttgccgggttggctgagacgatcaccgaccgcatggatcgcaaggcccgcctgccgctggtgcaggagacgcccgaggaactgatgcagatggacgagcacgacatcggcatccacttccgactgcccacgttggcccgcaacctgcgcgccctgcgtggtggtgacttcggcatctacgccatgcgtcccgacgcaggcaagaccacgttcctgaccagcgagtccagccactggatcacgcagctcgacaacgtgtggccagaccagaagcgcaccggcatctggctcaacaacgaggggccgggcaagcgaatcaagcagcgctggtatcagtcgttgctcggcgcgaccatccctgaaatggtggagtgggcgaaggatggcagcatccgcaagcgcatcgaagatgcgatgggcggagacatccaccgcatgcagttctacgacatccacggattcaactccggtgaggtcgaggccatcatcaagcagaccaaccccggcttcatcatcttcgacatgatcgacaacatcacgttcaccggtggcatgaccaacggcgggcagcgtaccgatcagatgttggaggcgatgtatcaggccgcgcgcaactggtgtgtgaagtacgacgccgtgggcgtggcgacttcgcagatcagcgccgagggtgagggcatccagtacccgccgcagtccgcactgaaggacagcaagacgggcaagcagggtgcgtgcgacttcatcatcatgggcggcaagctcaacgacccggcgatggaacgcttacgctacatcggcaccccgaagaacaagctgcaccgcgcaggcggtaagcgtgacgttcgggaagaagtgatgatggatgcagagcgtgcccgcttctatcaggaggcagcatgagcaagcaggtacacatcgtggccgtcggccatagcgtctccgtgagcatccccggagactccacggaagcgcagaccttcaactgcgtgagcaacgcgcaggctatccacctcgccaagctgctgcgcaaggtgcacgacgagggctacatcgaaggccgcaacgacgcaccgcagtggaagtggggatggctgcggaacaagcacagcacttggatcggtgtgcactactcgccgcacaacaagcgctggtgcatcaacctgatcccatgcttcacattctggatcaccaagcccggaggtaacacaccgtgagtaccgaaccgaacatctatctgccgcgcaacgtgggcgtcatcacgtccagccgtaccggcagcagctacaccgtcgagccgcctgtgaccaacacggacatcgactacctcgtgctggtgcaggacttccaagaggccgtcgccaagctggtcgaggccgggtggaccctgtgctccggtgccgacgggcactacgaggaggacgaggactacagcgacacgtggtatgcgctgcgcaacggcgtgttcaacgtcatggtgactgccgacagtggctggtatcagcgcgcggtcgaggccaccaccatctgcaagcgccgcaacatcaaggacaaacaggaccgcatcagcgtgttccggtgggtgcgcgatgggctggacttggatggcgatgcgtcggatgaaatgtaccagcttgccctgcaacggtggccgctgtgagcttcacttgtttcgacctcgaaaccacgatcccctccatcctgaagcgcaaggccaatccgttctacgacatgaacaagtgtgtggcgattggctacaagcgcaagggtgacgcacggaacaccggcctgtactacgactgtcgcatcggcatcgacaaccagtacatgcccggcgcacctgacgggtggctgcgcgagctgtgttacgggcagcagttcctcgtcgggtgtaacatcaagttcgacatcctgcacgccatctgccaaggcccgctcaatcggcaggcatggatcgagcccatcgacggcggcggcatggtgtgggattgccagcttgccgagtacctgctgcacggcatgtgtcaagagttccacatggcgagcatggacgagacggctccccgttacggcggcaacctgaagtgtgatgcagtcaagtccctgtgggctgcgggagtggacacctgcgacatcgacaagacgctgctgatggattacctcctcggcaccaacgacaccgacgacgtgggcgaccccggcaacaccgagaagatgttcctcgggcagctcgccgccttccgtgcacgtcccggtctgcgctcggcgctgctcaacatgggcgcgctgtgcttcaccatcgaagccgagtacaacggcatgtacgtggacaaggaatgggcgcttgcgaaggcgaaggagttggaggtcgagcttgcaacagcgtgtgccgaactcaacggcttcatccccgagttgcccgagggcctgaccttcaactggaacagccgcttccacaagagcgcgctgatcttcggtggcaaggtgaagtacacggccaagcccccgatcatgtccaccgagggtgggccgacctacgtacagaaggacgaggtgcactatgtgctggtcgatggtacaacgacggcgacgccaccggccgaggacttcgaccccctgtggcggtacaccacctacggcagcggcaagaataagggcgagtacaagaccaagaaggtgcccgtcgatgacttgaccaagcagaagttccgcaacgaggacatgctgttcgagttccccggctacaccgagccggatgctgcgtgggaaagcaagagcgatccgggtgtgtactccaccgccgccgatgtgatcgaggcgctgggctatcgcaactgtccgttcaccaacgcactggcccgccgcgccgacatccacaaggacttgtccacgtactacatcacgacggacgagaagaccggcgagcagaagggcatgctcacgctgcccggaccggatggtatcatccaccacaagctcaacatgaccaacacggtgacgggtcgcctgtcatccagcgatcccaacttgcagaacgtgagcaagggtgagctggacgaggagacgttggaggagaagggttctcagatcaagcgcgccttcgtgtcccggcacaagggtggctgttgtatccagtcggactacacctccctcgaaatctacgtgcaggctatcctcaccgagtgccgtcagctgatccccgacctgaaggcgggcctcgacatgcactgcctccgtgccgagcaggcgtggggcgagcagggcaagtacgactacgacttcatcctgaaggcgagcaaggacgacaagcatcccgagcacaagaagtggaagaagccccgcggcaacgcgaaggtgttctccttccagcgtgcatacggtgcaggcgtggcgaagatcgctgcgtgtaccggcatgacggaggaggaagtcgaggcgctggtgcgcggcgaggccgagcggtacccggaactgggttgttacatcgaccgcatggtcgaggccatcaagcgcaaccgcgtcagcaccaaccgcttcgttccgcaccccgacgccggacggcagggcgtgcctgctgggctgacgtgtcagctgggccggtcgcactggacccccccggacggcaagatgtattccttcagcgagtcaccgtccccggtgttcatcgccaacaagcccgcgagcaagggcggctgcgcgtgttcgttctcgcccacggaaatcaagaactacccgatgcagggcaccggtggtgagtgggccaaggcggcgatgtacgtcagcctgcgcgccttctaccggaagtacgtgaccgaaccgaaggagtggttgggccgtgcgttgctcgtcaatcagcagcacgatgccgtctacgtggatgcacatggcgacatcgcaaccaaggccgctgctctgctgcacgcctcgatgctggaagcgtcggtgtatatggagtggtggttcgtgtggacgctgccgcttggcgtcccgtgcgaaaccaagatgggcgacaacatgatggaggagaagaatcctcccgcagagttcgccggtctggtcatcgagtaccgagcgtctatccgcaaggacttcgtaggtaatcacaacccgtcgtttgaataaggagaacaacacgcatgagtcttgacgcactgttgaacaaggtcgccacgcagggtaaggaccagtcggtcgccagtggtggcaacttcgactacaccccgcccgctgccggtgtgaccaccgcccgcatcgtcgggtactacgagctgggcaagcacgagttcgagttcgagggcaagaagaagacgcaggatgaagtcgccatcgtgttcgagctgaccggcaagcagcacccgcacatcgagacggacaatggtccggtcccggtgcgcatgacgctgacgctgggcctgtccaccaacgagaaggcgcactacttcaaaatcttcagccgcctgcgcaccgaggagcgccacttcgtgcagctgctgggtcagggtgtgctgctggaagtcatccacaagccgggcaagcgcgacccgaacaagaccttcgccgagatcgacaaggcttccatccgcaagccgatcatgccggtgccggaaatggagaacggcatcccgaccggcaagttcgtggacaccgtgatcccggtcccgcagcagatcaccccgctgggtgcgttcgtgtgggacttcgccgatgccgaaatgtgggacagcatcttcatccccggcgagtacccggagcgcaaggacgagaagaccggcaaggtcacccacgaggcgcagtcgaagaacaagacgcagctgcgcatcgctgcggcgctgaacttcaagggcctgccgtgctacgactacgccgctgccaagttggcgggcagcaccacggtcaccaaggaaggcgtcgatgcgctggacgaagtggtcggcgacgtggcgaacgctgcgcccaccgacgctgctccggccgacgacaagccgccgttcccggtggacggtagcgacccgatggcaggcatcgcctgatggacctgagcgctctcatggctgcggctgtggagcgctccccgatgccggtacaagtggtacgtcaacactgtccccgcgtgatcgctcacgtggatggggactacatggcgtacttcgcggctggtagcgagaactgctcggcgcccgatgcacggcgcaacgtgctctcccgctgcgcacagctgaagcatatcagcggatgtggtaagatcgtcatgcacctgacgcacggcgcatccaccaagggtgaccgcttcctcgctgctaccacgcagccgtatcagggtcagcgctgtgcaggccgcaagcccaacaactgggcgttccttcgtgagtggatggagacatacgagggcgacgctttcactcccaaaatctggctgacgcgagaagccgacgacggcatcgcatacgtcaacgagggtgcagcattgcaccacaacatcctgcacgtggtgcacagcgccgacaaggacatgcgaatgttctgctgtgtgcatgtagactgggaaggctacggcatcaccgaggttccgctcggcgcttacgacatcgtgggcgagaacgggttgcagtacggtcacaagtggttctggatgcagatgctccacggcgacaccgccgacaacatccccggtctgccgaaggtaggcaaggtgacagcggagcagctgcttctcgaccccaaggacaacctcgaagcggtgcagctggtgagcggcaagtacagcgaagtgctcggtgccgactggcgcaagacctttgccgaacaggccgtgttgctgtggatggtgacggatcgtgacgctgaactgctggacgtgctgaagctcgacgtgttcgggccgcagctgaagcaagcattctacgactgtgccgaggacgtgaaccccaagcgcgcaatcttggaggcatacaaagcatgaagcgactcactgcaacgcaggtcaagctgttgcgcatcaagctcgcagcggagcaagggaactgttgctgtctctgtcagggacagttcggcctgaaggctccgctcgatcctgtgctggaccacgaccacaagaccggcgctgtgcgcggggtgctcgtgcgcggatgcaactccctgctcggcaaggtcgagaacaacgcaggccggtatggcgtgcgcgatgtgttcgcattctgtgcgggcatccccaactacctggtgtcccacctcaccaacatcacggggtacctgcatcctacctacaagaccgacgacgagaagcgcatcgctcgcaatgcgaaggcgcgtaagcggcggtcactcaacaaggagacaccgtgacccttacccagttcattcgccgagcaccgaagcgcggcccgaagattctctgcctcgacatcgagacgttccccatcgagttctacggctgggggatgttcaacaacaacttcagcgtcaagcagatcaagcgtgactggtcgctgatgtcgttcgcttgcgagtggctggacgatgacgagtcgttctatatggaccagcgcaacgtgcgtgatgtcttcgatgaccgcaagcagggcaaggcactgtggcacctgctcaacgccgccgacttcgtgctagctcgcaacggcaagaagttcgacctgcgcaagatcaaggcgcgcctcgccatcctcggcctgccgcccgtgtcgcccgtgcaggtgatcgacccgatgctgctgaaccgcaccgagttcgccttcacctcgcagaagttggagtacaccaccggcgtgatcgtgccggagctgcgcaagtacgaccaccacaacttccccggcttcgacctgtgggtggcctgcatgcagaacctgcccggtgcgtgggacgagtgcgaagcgtacaaccgcatcgacgtgaagtccatgaagttggagtacaagaagctgcgcggttggtactcgcagcatccgaacgtcgccgtgtactacaaggccgatggcagcgagcaccgctgcaacaagtgcggctgcaacgaaatgatcccgcaggatgatccggcccgcacacaggtcggcacgtacctcctgcttcagtgcaccgtgtgcgacggctacagtcgtgggcgtaagctgacgaccagcgccgaggcccgcaagcacatcaccgttccggcataaggagccgacatgaagatcaccgacatccgcagcggcatgcgggtacagtacaccggaaatgcgcccggcctgatcgggcggcgcgggaaggtaagccgcgtgttcgctaaggatgtcgaggtcttcttcgacggacgtgtgagcgcgagctactgcgttcccgattccctccgacagcttatgagcatcggaggtgtgaccaccaccagacgagaggtacccatgcccgaactgaactaccgcaacgaggacgagcgcacgctgtccgaccgtggcgtcggcctgaaagatgacggcggcaagccgcaggctcggctgctgcatgagggcgtgcctcgtgcactggcccgcgtcatcgacaccttgaccttcggggcgcagaagtacaaggcgcactcgtggcagcatgtcgagaaggcgctcgaacgctatcaggatgcgagctaccggcacgacaacaagcgctgcctcggagagaagctggacccggagacgggcatccatcaccgcgcgcaccacatcatcaacgagctgttcctgttggagttggaactgcgcgaggaggagcaggcccgtggcgcagagtaagggtcgctcgatcaaggaggcgtgggtcaacatcgccatcgggtacagcatcaactactgcgcgaacatcgcgttgctgccgctgctgtggcatcccgaacacccgcttatgtcggcccacgccatcggcgtagccttcacgcttatcagcttcgtgcgccagtacatcatccgccgctggttcagcaagggtgactgatggcctgcgcccgctgcggccaagtgcaccggtacgtcccacatgaggccgagtgggcgcgcttcctagaggagcatcgtacccgcaagcagttcgatgtcgagtgggccaactcactctggcatcgcacataccctgacgacgccttctgcatccttgtgatgaagggccgcgcaggtttcgttccattcccgtcgaaggagaaatgaatgctctacaagaaccagaccgccatgcttatcaagtcctacgagaacaccgtggcgtggggcgagagtgccgaccacgaggaggcgttgcagaacgcggtcaaggcgggcttcccgaacctgccggaagaagatcaggccgagctgtatacccgcatcgccgatgcgtgggaaggctaccgtggttcgctcgctccgcgcaagctgtggatcggcaccatcgtcaaccagttcatgtcgtcccgcatcgcacggttcaacgccgcactgggcgatggcagcaagaaggaggacagcgccgatgtttgacatcaagcgagataacgtgcgggtcgctcccggctacaagaagcgcaagcgcggcttcaagatcaaccgcgccttcaccaagggcaacttccgggtgacgtggtacgacggcaaggccacctactgggagcagtacgtgccgtggtacaaggtgccgctcgccatgttccagatttggagggaccacgcatgagctacatcgtccactgtgcagtcgagcaggacaagatcaagaagaagctgcgtcccaccgaggagcagccccgcaccgagtacatcgcacagcccaagtacgacggctgcatgttggtcgccatcaagcgcggccactgggtgcccaccgtgaacaagggcctgcacgccatcaaggtctgtgacgtgcagatgcagcccgtggatcgcggcgtggtggacctgttctcccgcaccggcgagcaggtggtcagcgcgcaccacatcgagaacgctctcgcttccgcaccgttcttcccggtcggtgtctacttcggcccctactggcacccgaccatcgaccagcccaccgtcagcggcatgttccgcaagaaggacggcacgcagtacaccgagccgatgttcgtggtgttcgactacgtgacgctggaagaatgggagcagggatacacccacctcgtgtatcaggagcgcgtcagccgcctgccgagcatgggccacgccatcgccgagggtaccgctcccgtgttctacgccgagtcgcagggcttcctgatcgaccaagagctgggcagcatggaggcggcgaagctgctccccgagggtggagcatgtgatggcctgatcctgcgcaagccgagcggcaagtgggtgaagggcgacaagggcacgaacggccccgtcgtcaaggtaaagcccacaatcacgctggacctccgcgtcgaggacatcggcgtctgtgttggagagaagaccggccgcaacgtctacaccctgtgggtccgcctgccgaacggcaaggcgcaggaggtgggaagcggcgtgccgcaccatggcaacggtgttccgaaggtcggcgacatcgtggaaatcgagcccatgtcgtacagcaagttcggtctgctgcgcgagccgtgtttcaagggaatccgctacgacaagccggaggctgaccaatgagcaacgtcaagaccgaggtgtggcacaacatggaacgcgacacagtggaggtgcgagtgagcatcccgttccgcgagtacgccggttccttgtggccgaacgagacggcggtgatcgaatcgctggatcgcttcctcgccgagcggaggggctgatggacattcgattcggaaagcccgagctggatttcggcggtgatcgcttcgctccctacggtggaggtcatgtaaccgtgactgccactgcgtggtgcggcaccgagcagttcttcaaccgtcagtgcatcccgagctacgaggtcggcggcgacgcatggccgcacatcatcaacgaaatgcacaccgcactggtctgcatgatcctgaagcgttacccgccgacggacttcaccatcaagcaacggaggtagcatgctctcgtgtgtggaactcgaactggaaacctacgccttcggtcccgagcgcatggagaagtccatcgcccgcaacgaggagaagggcggcgcggacaacaacccctacgcccaagcagtgtatcgccggttcgtgctttgtcttgcggagcgcatccgtgcggacatcgactccccgcgcatcggccgcgcccaagcgcacgtgtgtcttctgcgcgccaagtacgatcccgagcgtcagaacaagcgtggacaggccatcagcgccgaggaacaggcccgcgagtggtacgaggctgtggccttcgtcgccgttcgcggtgcccttacctcttgcatgcgtgacaagcacggcgaacccagcgaccgcgacgtgctgaagaacgtcggcatcaacgtgtaccacgagtacctgctgacgcagttcgccgacgcagagccgacgctgttctgtcacctgatgaacgacatggaccgcaagctctctgtcaacgagaaccaccgcatgacggtgatgaagatgcagggtcgcaagaacggcatcgagttcgtggagtgggggcaggcgcagcgcgatcaggtcggcgcgtacctgtgcgaccagcttgcacagctgggcatgttggagattggcgtagtcaccgagactgcggcccccgccggtgcagcgtaccggaagttccagaccaagacgcacgtcaagatcgtgctgaccgacgaggtgcgcaagctgattacgcagatcagcgacttcgtgatcgaggccacgccgttctacctgccgtgcgttgagccgccgatggactgggtggacatcgacaacggtggattccacacgaaggaaatgcggcggtgtaatccgtggatggtgaagacctacgctcagacgcgcgacgagtaccgcgccgccgagctgcgctgtgagatggctgcgatcaacgcattgcagcgcgttccgtggcgcatcaacaagcgactgatggaacccgtgtcggccatcgccaaggtgcacgacatggaggaaatcatttcgcagggcgagctgccgaagccgtgtaagccggagtggttgaccaaggacatgtgtaaggaaaccatgtcccacaatcaggagttggagttcaagcagtggaagcgcgacatgtgtaactggcacaccgacgagcgcctgcgccagaacaagggcaatcgcttctacaacgcaatgaaggtggcgcgtaagttcgctgagtacccgagcatctacttcgtgtacttcgcacccttccgtggccgcaagtacgttcagaccaccggcgtgtcgccgcagggttcggacttgcagaaggcactcttggagttctccgaaggcaagcccttgctgacgcccgacgcgcaggattggttctgcatcacgggagcaaaccgatggggttacgacaaggcgtcgttgccagaccgagtgaagtgtgtgcgcgagcatcacgaccagatcatggccttcgctgcggacccggtgaacaacgacgagtggaagacggccgacaagccgttgcagtttctgagctggtgcatggagtacgagcagtggcaagtgttcggggatcgcttcctgagccgcatcgcagtcgggatggatggttcgtgcaatgggcttcagaacttctcggcgatgctgcgcgacgcagcaggcggggtggcgacggtgttgatcccggcaccgctgccgaatgacatctaccagatggtcgcagaccgcgtgactgcgatcctgctgggcgaggaggaagacgccgaagggtaccgcacgctgtggctcaaccatggcctgtgtcgctcgctggtgaagcgcagcgtgatgactctgccgtatggctcccggcagtcctcgtgggcggacttcatccccgaagactacctgaagtgcggcaagttccccacgctcgacaaggccctgtacggcccagcagcgcgcttcctgagcaagcgcatgggtgaggccatcgccgacaccgtggtcgccgcagcgggcgcgatgccctggttgcagcgcggttcgggtgcgatcctcaaccaagggtacgaccgcatccggtggatcacgccgtccggcttcccggtggtgcaggtgtactgggaatccgaggagcaccgcatcaacaccaagctgtgctgtcccgtgaagctgtccctgcgcaagagcacggacgcggtgaagaagtcccggcatcgcaacggcatcgccccgaacttcgtgcacagccccgtgtgtagccacctgacgctggtggtcaacgccgccaaggccgaggggatcgacgccttcgccatgatccatgacgacttcggcacccacgccgccgacagcgcggccctgtaccgcatcatccgggaggtgttcgtggcgatgtacgagcggcacgacgtgctctcggccttccactcagcctacccgttcctgccggagccgccgccgtgtgtgcccctggacctgcgccaagtccttgattctccgtacttcttcagctgacggagtttcagtacacctatagcacacaggccaaccgaggtccggttggagcggccgcgattgtaagcggaaccggtgccggaccttttggtacacctatagcacagaggagacaccatggccgaagacgccaaagtgaaagtcctgatgacgctccacccgaaccagcttgccgccgtgcggcgactgtccgggctgtcgctgtccgtcaactcgaataccacgcccttggaggcaggtatgcagttggggatggcccgcgtcctgaacatcttacaggagggtttcaccgttgatacctccgtaccgaacaccaacgacgggtgatagtgagcagatcaaggcggctttaacggccgctttgtatctgtcatctagagaagatagtaaggtagacaacagagagtcttctgtaagctacaactgtgatgatcctgattatacagtagctctgataactcagaacttagtagatgcagtcatcatagatgaagcctacctgctatgctttgccattgtcacaccgtggtattccaagaaccgtactacgttcgttgagaacatggtgctgcgcattgggccgggcagttccttcgaccggtacatagccgtgatggaacatctggctgacatcaaccactgtgactccctgagcgcaggcggtgcactagctcggaactcccgagcactcacacggatgtatgcacgctacggctacctgctggaacggcatgctccccaattcaccaagcgaaggagttaacctatgggtagcatcgttggtggtgggtctgcaaagaaggctgcgctgaagcaagcggcggctatcgacaagcagaccaacctccaaactcaatccacgaactaccagattcaggcgatggccgatcagatggcgcaggcagctgcacagcaggccgcatccgagtacgccgagaagttgctgagtgcccctgtcgataccgtcgatgtgcgactgggtacttctgacctcgacttgcagaccgccgacctgatcggccgacgcaagaccgcccgctccacctacacccggcccgtgaccacgaccgcagcttcccggctgacgaccgtggccgggtcagacctgttgtgaggtgagcatggaccatcccatccaaaccgcttgtcccgtgtgtgaggcttacgacaacaagcggcagggcatcatgtaccgatgtgaacgctattcgagctggaccgtccccaagctgttcgctcgcaagaaccgcgatcaggacaccgagccgctgacccacgggttccagtatctcggcgcacaggcagttaaccatctggcgaacaagctgatgatgtcgctgttcgcaccgtcccgaccgttcttccgattggagctgaagcgcaaggcgaagcaggctgcgcaggaacagggcgcggacttgcaggccatgcaggcaatgcttgcgaaggccgagcaggacgccagtctcgaactcgacaagcgctcgatccgctcccgactgtacgacctgctgaagatgctgatcgtgctgggcaacgccctcatggtgttggagaaggacacgtgtcgcgtgctcaacatgcggcactacgtggtcaagcgcactcgctgtcccgtgctgtacgaactgatcctccgggagaaggtgcacaagacccagctggaacccgccgcactcgctgccattgtcgcacacccggacttcaagcccgatgacgacggcatggtgtgggagtacaagtgggtcaagctggaccacaagaccggcaagtacaacgaagacgtgtggatttgcaactgcaagctgcccgcaaacttctcctcgacctactccgcagacaagctgccataccgagcggtaagttgggacttggccgcaggcgacgactacggctccggcttggtcgaggactacgaggcagacttccagtctctctcgatgctgtccgaggccgcagtgcagggcgcgatcctcgcatccgagttccggtggctggtcaaccccgcaggtcagacctccgtcgaggacttcatggcatcgcccaacggcgcggccatccccggcatgaagggcgacatcgagctgattaacgcaggcgtcgatggcgtgctgcaaaccaaccaagcaatccagtccacctacatcaaccgcatcggcgcaggcttcctgttgcagacggcggtgactcgtcaggcggaacgtgtgaccgcgcaggaaatccgcatggtcgccgaggaactggaaggcgggctgggtggcggctacagccgcatcgctgcggacgtgcaggtgcccgttgccttttgggtgatgaacctcacgggccgcgacatccgaggcaaggacttggagcctgtcatcatcaccggcttggccgcgctctcccgaacgggtgaccgtgaccggctgttggagttcggcagcaacctcgcaaacgtcctcgcgctgccgccgcagattctcgaacgactgaagctgtccgcgtggatcgccgacctcgccgccgctggtggcttggacccgaacgtatacgtgctgactgaggccgagtacggccagatgatgcagcagcgtgcgcagcagcagctggtcatgcagaacgcatcgcagcagatcgacaacgccaacaacatggagacacagacacaatgagttccaacgcacctccgggcggtggtcccggcgcaaccgtgatcgcaacctcgcacggcaaccagcccgccccggcagctccggctccggctgacgacaagctgctgcccaacggacagcccgcaccggctgcaccggcacagcccgcagctcctgctgcgcctccggctgctgacgctctgagtctcgaacccgctgctcccgcacagcccgccgccccggcgaacgctgcgccgactgctgtgtcgattcccgactacggcgacaacggcctgaacatcgcggccgaatacttcgtcaacaccgtcggcctcgacatcgacagccgcgaactgaccgaagcagcgaagggcaacttcgccctgctggaagccaagctggaagtcctcggcgataaggccaagggttccgcaccgatcctcgctctggcgaaggagagcatcgctcgtgtcaccgccgctgcaaccgcagcgcatgccgcgaacgttgctgctgtccacgaagccgtgggtggcgcagagaactgggctgcgatccagcagttcgcacgggccaacctgcccgccgaccaactaaagcaggcaagcgaatcgctgtcggctggtggcttcggcgctcaggcgaccgcgcgttacctgatggctctggcacaggccaatcccgcgacgaccgtcaagggcgcaccggctaccaatgccgccgctcctgccgcgtcgatcaacggcgtcgctcctctcacgaaggagcagtaccgcgctgagtaccgcaagctggttgccgagaagggcatccgtggtgcggcccactccgaagaactgcgtgcactcaacgcgcgcgtcatccactaagaaccaaggagcaacataaagcatgagcaccatcttctgtaccgtcccgccctgtccgaatcaggtcaaccagtccggctgtgagaacgcgctgatcctcgaacagttcaccggcgatgtcgagcacacctacccctccagctcggtgctggaaaagttcttcccgcgcaagcaggtcaagggcacctgtaccctgaccaagaaggccatcggccgcaccaagcttcagaagctgaagcgcggtgatgcgccggaccccaccccggtggacttcagcaaggcgtcggtgaccgtcgataccatgctgctgtcgcgtcacagcatctggcagctggacgaaatcttcaccgacatcgacacccgcaagtgtatcgccatcgagcagggtcaggaaatcgccgagttcgtggacctgaccatcagcatcgccgcctgtcccgtggctgctgccacgcagtcgatcttcacccgcaacggccgcgcgccggaaggccacttcggtgccacgcaggtggtcctgtccgctgccggtgacgagaacgatccggccaaggtctacgccgccatcggcaagctgttctcccgcatggaggaggagaagaaggtcaagccgcagcgccccggcgtggtcctgatcgtgcgtccggcgatcttctacctgttgcagcaggccgagcagatcagcaacggcgagtacctgacctcggacggcaacaagctgaccggctgtccgaccttccacggctggggcgtcccggtgctgtcgagcgagaacctgccgtgtaccgtgatcgaaggtcacctgctgtcgaacgacgacaacgacgacttctacgacggcgacttcagcaccctgatcgccgtggccgtgtcgccgaaggccctgctgatcgccgaagcgctgccgttgcagtcctcggtgtggtggagcgacgcctcgaagtgctacttcgtggactcgtggatgtccttcgccgttggtctggatcgcgtcgagaacgcgggccgcatcgacaaggttgcctaatccgctgggcgcggtccctgaatccttcgggtaactcaaaccgcgcccgccttccaccaacacaggagcaccatcatggtctttgaccgaccgttcgagatttccaaccgcgtcgtcgccgctaccggcgtggccggtctgcccgacaactccgtgggcaccgtcgtcggcgtccactacgacgccatcggcgcgggctgggtcgtgcgcgtccgtttcgttgacgacgaaatcggctcgcaggacgtggagtacgcaccggcctcgctggctctggctgcggactaagcaacatcccggcaggggcgctacggcgtctctgccttgttcctctcaggagacaccatggcattcatcaccaagctcgacatcgtgaacgcctgcatcaagacgatgggcgagacgaagctcaacactctggaagatgaccacgtatacaaggacgacgcagttgacttgatcgaccgcgtgcaccgcgacgtgtcgtcgctctcgctgtggttcaacaccgaatgggtggagctgaaaccgcaggcaacgagcaagtacatcatggtcccaacggacgtgctgaagctggactgcaacccgagccgattcggccacgtggtgcagcgcggacgccgcctgtacgaccgcaagcgcaacacctacgagttcgaccacaacgtgcaggccaagctggttcggctgctggacttcgatgacctcccctacgaggtgcagatgttcgtgcgggacgacagcgtgctgcgtttccagtccgacttcgacggcgacaacaccaagtacgccaagatcaagcagcagcgcgacgactcgtggatcaacatgaaggccgagcatatccggcagatcaaggcgaacccactgttcgcgcgtgcgtccgtggacgtgctgcatcagcggtacttcaactacagcggacacccgtggcatagccactacactttccccggctaaggaggcaacatggcaaaggcaggcggatgttatcccgactgtgtgcagggtgtcagtcagaaaccggcgcacaaatgtggccgggccagacgcacgagcagatcaacgtgctgtccgatccggcccacggccttgtgcgccgtcgtggtacgcggttcgctgcttcccaagccgttgtcacctcggccgagctgcgcaacatggacgtgttcgacttcatgcaggaaggcaaggagtacgcgctgctgtatcggcgcgatccctctacctgtggaagcgagacgttcgcgttcctttacaacaagacggacgaggcgttcatcccgctggtctacgagaacagcacgtgggtcaacacgctggtcagcggcggcgcgtcgtcgctcgcggccatcggcagctacgtctacatcgcgggcaacaccacgatcccttcggccaccagcacgaacgtgtggcaggagcagacgaacatccagcgcctcgccgcgtgggttcgcactggcaagtacaacacaacgtacacggtgtaccccccgcgcacggacaacacggtgcaaacggttacgttcaagacgggtgccgcatcgtaccccggcacgctcgacacgagcgacatcccgttctacctgcccggtggcacggagccggacccggcgtatcagaagtacgtcaacgaccgagaaaacgagtacaactccgcagtcaacgagtggatcggtgccagtgccgagcagacgcgcccggagtacatcgccgagcagctgtcggatttgctggtggacgcgggcgtggcggctacccacatcaagggcggcatcatcattgacgacgaccagttcaaggacatcacggttgacgacgagggcgacggcacgaccttctacgccgcagggcaggagattaccgacgcgacctacgctgtcaagttccactggcacggcaagatcatccgcgtgcgcccgagcggtgcaggcgcggacgagacgtactacctgcgtgccgagttggagaacggcgagacttcgggctacggctcggtggactggtacgaagcgcccggcgtggagtgcaccatcgacaacctcgtgtcgcagctctacatctacaacggtgtgggctacatcgcacgcaacggcgcgggcctcacgtctctggctccgggcagcggcgagcacccggcttacggtgcgcgggttgcaggcgacggactgtcctctccgatcccgtggttcatcgacaagccgatcaccatgctgtccgtcttccaagaccggctggtggtgggcgcgcagaactacgtcaacgcctcgcggtcggcggactaccgtgacttctggcgcggctctgccgtcaccatcgaagacagcgaccccatcgaaatcttcgcgcatggcagcgagggcgatgtgctccggcacgccacgctctacaacggcaacctcgttttcttcggtgaccgtcagcagtacgggatcagcggcgactcggtgttcagtccgaagaacccgcttatcaaggcgttcagtgcgaacaaggattcggtggacgcgaaggcgcagacctcgggcaactacatcttctatgcgcagtacggcagcgaaggcacgagcctgcaccagatgcgcgtcggtgcgctcaacggtcagcagacggccccggacgaaatgtccaacgagctggactcgtggctgtccggcacgccgttgcagatcaccgcgctcactgccccgaaccttgtgttgttccgcacccgagagcacccgcaggacttctacctgtaccggtacgaggacaacaagaacaatgggcagcgtatcgtggactcgtggtcgaagttccagtaccacccggcgctgggcgaaatcatcggcgtcagcagctacaagaagaacggcctcgtattcaccgcacgcgggtcgctggtggcgtgcgacgtgttcgacccgaagggcgagccggactcgcatgcgtgcctcgacagctgggcgagttttggtacacctacgggcgtacaaaccgcgagcgcaagcatcgccgtcaatagcactagcccgtacttcctgctgggttgtccctacgctcaggcgtcggacttccttagccagttcgatgacctcgatgctggtgcgctggaatacggcgtcgtgtctgaggcgctgggtgtcccgaccaatccgttccctcgggaccagaacggtcaggctgtgctcgatggccgcatgtcgcgtgacaaggccccggtggacgtggagaacacggcgggcatgctcgctgcggttaccacccgcaacaacagcgtttccaccacggacttcgagggccgcatcctcggcgactccgacaacctgttcgcgcggcaaccggtgtaccgggggcagcgtgacatcagcgtcgggcgcgaagtgcgtgagtgcacctacgagattcgcagcaaggattggctcccgctccgggcccccggcctgtgctggacgggtcagactttcaacaatgtacggagggttcagctgatgggttcggttcatacgatcctgcaagcgaacaacaccacccgcgttgcccgtgcgaactaccgtgcagccgttgcgcagaccgacaacacgaaccgcagcgaggtcgccaagaccggcttcgctgatttcatgcggtccctgaagaacaacgcccagctggacgccgccgcgaaggagtacaactccaacatggaggcgctgtccgaggagctgcgtgcacgccaaggggctgggcttaactcccagctccaactggcgaacgcgcgcggtgcgcttcaggcacaggccggtgctgtaggtgtgggcggctcgtccgcagacctgatggataccatggttcgcttgcaggcggaaatggacaaggagacgcaggacaacgcagtctcgctgctcgcctctcgcggcgcatcgcagacggcgcaggtcatgtcgcgcgcgtggaatgggatggacatgagccgcacgttcggccagttcgactactcgcagcacatcgagccgaaggcgatgaagcgtcgcttgggcaagctgatcggcgtggccgtggctacctacttcggcgggccgatggcaggcgaggctgtggcagacttcgcagtcggcacgtggcaggcggacaacggcaacttccaaggcatgtcgcagtccttcaacaacgcagcgcagaacgggatgcaggcgtggcagcagtccaatgatcgcggcggcaagtcgtgggcgtccactaccttcgggtacaacgacggcaccggcaagcagtccgtgaccggggcgaaggtcaccggcaacttcggcaacaactacgacaacttctccaccactacgtccggcctcggctggttcgacagtggcagcggaggcaactcaggaggcgcatggtgatggctgacatcggcacggttaccttcaacacgcagtccgcattgcagggtggcatcaacgccacccccgcactgtcgggcaacaccagcattcaaggcgctggtgtgaatcaggtcggccccgttcgctcgggatcggattggttcgagagcactggtggtatgacgatgccggacagcaacctgcccgagttcttgcaggaactggcagcgccgaacaccgccaagctgaagcagcagcagatgtgggacggcttcgttgccgcccgcgctggtaagaccatggacgagattgctgcgaccgagccgtggtacaagaaaatcttcggcgacaccaactacgagattggcgcgagcatgtataacacgctctcgcaggtcaacgaaatggagagcgacctgctgcggcgtatgccggagttgcgtaagcttccgcccgaggcgatggcgaaggagttcaacgacctcgccactgcccggatgaccggcaacggtttcgcggacacggtgttgcagaagaccttcatggatcgcgcgggttcgctgatggacctgcacacgaaggagcgcacggcgtggcagcagcaggagctggtgaaggcgcagtacgctgcgaactcgtcggcgtccactggcttcaacgaactggcgaagcgcacggcgatgctcggtaccaaccgtcccatggacgagaaggccaccgaggcgctgacacaggcgcagctgtcgttgctcgacggtctgtcgccctcgcgttaccagacggacgagtcgtacaagtcggcgatcaccgcgttctaccgtggcgctgcggatcgcggcgagttccacacgctgaagttcctcaacagcaagggcgtgctgaacgccatcgaccccgacgggcagctgggaatccagcagtacgtgaagcaggcgcaggatcggtaccgctcggactggctcgatgccaacccggagcaggccgagaagatggcgcttgtctccatgtacgcatccgagggcattggtgccaagccgtcgcaggcgatgatcgaggaaatgaacgcgacctacgccgctgagacgggcagcgatgcgccgctctactcgggcacgcagcttgcttcgatcatggcgcagtccgcaggcgcgcacatccgcgcgcaggaagccgtcatcaaccagcgcaacgctgcggctaaggctgcactgactgaccagcagaagctggcggcgcaggaggaggacatccgtggcggcatcgagtcgttcaagcgcggcacctacgcgcagacgatcaacatccccggcgtggacaaggagctgatcgaagcgaacgtggtgcaggcgtggaactccacgatggccgcgaacccgaaggtcgccatgtcgcagctggtgtggaacgccaacacagggcgcggcgctgtgctgaagggtgtggccgatcagttccagaccacggcgcgcgctgtgctccgcgatcagccgaacacggcagcggctgcgctgtaccagcagtggaaggaactgaagcagacgaccgctgcgcgcatcgacacgaacggtcagcctgtgcagggccgactgactggcgcaactaccgccgcgctgtacttcggagatagcgtcaacacgttcttcaacaagctgcaagcgttggagaatggcggcgtgaacttcgagcttgcctacgaggtggcccgtggagaaatcaccaccgacgatcccacgcagttcgacgcgaacagtcgtaaggaatccgaggctactcaggctcgtgttaacgacgctatcgcaaagctcaaccccaagtacctcgggatgttcggcaacaagctgggcgactctggccgcgctgcgtatgctcgcgccatcgtccggtcggtcaccgacagcggtgggctgctggacacttctgcggaaggtttgcaagctgcggctacccacgctaagctggcctacggtctggaagacgcgggcaagtacgcatgggagaacggacgcgacgacgaaggccgagtgatcggcggtgttggtgcgtggctggggttcatggacacgaaggagacgggaccggccatcgagaaggccatcgacgcagcactgcggcgggtcaacatcgagcctactaccagtctgaaggctgacgtgttccgcatgaaggacagcgagaacggcgagccggtgctgtacgtcaacgctgttggcgagaagggctggaaggttgtgccggtgtacgggcgcgacatcaaggccgagtacgagaagcacacgaagcagcagcggcagttgcaggccccggtaccgcagggctacgttcgcatgaacgacggtacgattcagcagagcatttccatccaacccaaactgtaaggagatagacaatggcactcgatctttcggggctgtgtcaagaccagcagattgccaaggctgccgcttatgcgggacccccggagtccatcgtgaaaggtcagtggcgagtagagtctggcaacggacgcgcagccaagaaatgtcccggtgtgatccgcagcaaggcaggagcgcagggcgacttctgtaaagtgcccaccacgcaggcaacgaaagaagcgcgcaacggtcgcaagtacgacatgcgcaacttccaagacagctgtgagctgtacgccgacatcatgcgcgagaacatgcagcttgccaagggcgacgttaccaaggcgctgcgtatctaccaaggcggcaccaacccgaagaactggggacaggagaacgcagcctatgcaccgagcgtgctgggtggcgcatccgctcccgccgtgtcggcgcagccgcgcagcctgaccaccactcaggcagacctcaacgccgcgtggcagggcaacccgaacatgcgcgaccgcacgtggtccggcgcttccatcccggatgcgtggaccggtgctcccatcgaaggccgcaacgctctggcgtcggcagcgaaggaacacatcggcaagattcgtgcgggcatcgccgagctgtcgatgggtcaggtggcgcaggaaggtggcaccgcagagcaggctgtgggcaaggcgcaggccgtccgtgcgtcggatcaggtcgtgccgtggtgggtgcgtcaggaagtggacgtgctgaataccggcgctcgcaaggcgctgctggatcagaccgagcaggctctcgcacaggagcgtgcagacgaggagctgcgcaactcgctgaccttcctcgacaagtggggcgcggcattcgacagcggcatcggtgcggctatcagcaaccagcttgcgcgcgaggacgagaacatcccggaaggttggaagtacgacccgaaggaatgggagaagtcgtggatgaccgccgacgaactggaagacatccgtgacgctgcgtactcgccgaacgagctgaagtacgtgagcgaccgccagtggatgcgccgcaactccatgcgcatcaaggatcagcagaccggctggtcgagcttcggctacgacctcgtggcaggcttcaccgatccgggcaactgggctatcggcggcgtcaccgctgcgggcgctaaggtgctgggcgtgggttcggctgcgctggtggccgaggggcgtgtgggtgcttcgctcgcatctgccgctgcggagaacgcggtaggctccgtcatcacggacgccgctctggtgggcatgggcgagcgccgcaacttcgcggactttatgaccgacgctgcgttcgctaccaccatcggtaccgcgatgcacattccgggcgttcgctcggctgcgcagattcgggacaaggctaccatcgacctgtccgcaggcaacgctgccgcttacggcgaagcgtggtcggctgacctgaaggcgcgcgcggtggccgagcttggtgacaacgccaacccggtgctggtcaacaaccgcatccaccagcttgccaagcaggaagcagtcgattggctgcgcgctggtatggctgatgtgccggacgacttccgcatcttcgcgcgtcccgacgtgcaggagacgaccaccaccgcaggcaccactggtgcactggctcgtgacgtggacaacgtggacgcctcgaccggccggtacaacgacagcgtgggtggtcgggtagatcagcatgatccgctgctggaacgtgcgtggaaggccgcaggcatccgtggcggcaacgtggacggcgtgctgaagtatctggaatccaacgcctcgatcccagaggacgtgcgtgctatcgccaatgcgctgaagcgcggcggtcgcctgagcacggtgaagatcgtgccggagtcggaactcgacaagtggttcgccggtgccaacatgggtccgggtatgcgagtggccggtggctacaacgccgggctggacgcgatggcgatgcggaactacacgccggaagtggtggtgcacgaaatgctgcatgctgccaccctgcgtgagctgcgcagcaactcggtgttcggtcaggaaatggaagaactgctgacccacatcaacaacagcatcggcagtgtagactccacgctcaccaccgctgcaatggagacgcgcatcaaccagccgcagtcaggcttcctcgccaacaccgacgagctgatttcctacggcctgacgaaccgcgccgtgcaggcggtgctgcgtcagatgcctgcgccgggcaacacccgcccgaatgcgtgggagtggctgaaggacaagatcgcgcgagtgatgggcctgaagaatcaggagtccgctctcgaacgtctgatgtctgtggtcggcgacaacctcggtgctgaagtgcgcgacacgcaggcatcgacccgacagactcgtggcatgctcgccaactcgatcttcaagtcgaaccgcgagcgcaaggcgttctatcagcgcactggtctggacaagtccgtcagcgacgacgcgatgcgcgtgcaggttgccgaggtgatggcgcgctctgagcgcttcagtgccaagtatggcatcgacgcggcgaagctgtccaccatcatgcagcgcttcgggctggaagctacgagcacgaccctgatgtcgtccaagtcgccggtcgctcgtatgcttgctgtcaccctgttggagaacccggagggtgcggcaggccgacacagcacggcggcgatggatcggcatggccggttcgagtcgttcatgggtacgcgcccgcgtcagtgggaagcggcctaccgtctgtggcgcgcggacgttcgcggcatcggtgcgatcaaggacttcgccacgggctggaaggcacgtgcggacttcgagtacgcagtgaagctgtaccgcgagactcgcttcaacggtggggacatcccggatgcgcacgaggcagtgaaggcaatggcccgtgagctggaccgtggctacaaccgcatggcagcagagcagcgcgcggctggtacggtgggcgcacagcgtctgccggaggaagacgtggagggctacgagtcccgcacttggctgggtggcagcatcgctgctgctggtccggttcgccgtgagggtatccgtcaggcaatgcgcgatcagttcgaggtgatgggcgagctgtatggggacgacttcctcgacaagttcgctaccaagtatctggaacgcatcgagcgcaaggcggcgggtatcatcgaagcgccgggtcaggtcttctcggagtcgcaggcggacacgctgcgcgatactctgcgggcgatgtcgctcaacgaggaggagattcagaaggtgatgggcaagtacagccgtggcggtgcgaagcacaccaaggcgcgtatcgacctcgacgtgaccaagcagtacgaagatgctgatggcaagttccgcctgatggactacctcgacaatcgcgtgatggacaactaccgcaagtacgcgggccgtgttgctggtgacatcgctctggcgaagcacggcatcctcggtgatgcaggcatcaacgtggctcgcgaagcaatgcgcctgaccggtgcgactgacgtggagctgaaggcgttcgagcaggtgatgtccgagttccttggtcgcccggtgggcactggtgatccgactgttctggcgaatgcgcggctgctgacctcggctatccagctgggcggcgcgggcatcaatcaggcagcggagtacagcaacggcctcgccgctgttggtgctgctggtgtggctgacgcaatccgtatcgctcctcgcatgcgcagcgaaatcatgcgcatcctgaagggcgaggacagcggcaaccaaatcctcgacggcttcgagttcatcagcggtcgcggcttcggcctcgccggttacgatctgcacatgttcaactcgctggacacgcaggcgtcgatgtacggcagcgagcgcgcaggcttcctgacctcgctggtgcagaaggcagcgcatgcaaaccgcatcctctcggggcagcgggctgtgctcgccgtacagcagcgcggcttcgcggaagtgctgatcgccaagggcgtgaagttcctgcgtgatggtgccgaggccgacaccgccctgaaggacatgggcattgacgacaacctgctgaaccgcctgcgggcgacgcaggatcgggtcgtgcgctggggcgctgacggtaagctggaagcggtggacccgcgcaacgtcgaaggactggcggatcggcaggcatggttggcgttctacaacgcgatcaaccgtggcacctcgcagattcttcaggacaccttcatcggcgagactggcaagtgggcgcacaacggctggctgaagctgctgttccagcaccgcacgttctcgctggtcgcacagcagaagcagctgggccgctacgtgggcaactacggtgcgtggcagactgcgggcctgatcgctgcggcgatggccgtggctgcgccgctgcaagccctgcgcgtgctgtcccgcgtggccctgatgaacgatcaggagcgcgacgaagccatcgaccagaacatcctgtcgcctctggcgctgggcaaggccacgctgaactacgtgtcggcgacgggcatgctcaacgatgtgctggacgtgggcaccggtgtggctggtggctggtacgagtacgccaccgatacgcagggtccgacgtggctgaagcagctggccggtgggcagttcggcaaccgcaaggaagtggtgggcgggcagttcgcgcccgcgctgggcgtcgtcaatgacttcgctcaaggcatcgctggcaagccggagaatctggccgacgtgattccgggcgggcgactgcccatggtgatcccgctgttgaagggcgcggccagccagtggaaggaggagtgagaatcagggccaaggacggcccacccttttggtacacctatagcaaacaggaggcagcatggcagttccagacccgcagctgcgctacgcgacagacgtgttcgacgccgatggcgtgaccactgactggcagatcagctttaccggtggctacatcaacccgtcccacgtgtacgcaatgagcggactgttggacgaggagactcagctgctgaccgaccggactccgcacaccgtggaagtcctgagcgaagacgatgacgctagcaccgtccgtgtctcgcctgccgtcgccgctgggcgcaagctctacatctaccgcagcactccggtgcagcagatgctcgttgactacgttaacggtagcatcatcagcaagaccaaccttaacctcagcaacgaccagctcctgaagatcattcaggaaatgttcgactcgctcaacatcgccacccttagcatcgaccaacaggtcggcgtgatcgtggacctgaacgagattatccagaacatctataagcaggtcaccgagttgctggccgctggtggtatcgtgtccgtcgccccgcgcgtctggtccggtgcatggaccggcgatcaggtggacgacaccgacttcgacatggtgggcgcggacgtgtccggcgctggcttctacgacgtgtacgtcaacggaatcggcatgcagccggacgtggactatcaggtcactctggccgacgacaccgatcccagcttcatccgcttcgccacggttcccgccgagggcagcatctggttcgccgtgctgcgtggttacgccaagccctacaccgggcctgcgccgatcactgctacgagcctgcgggtgccgatcatcccggcagaaggtccgacctactacgccgacaaggctaccgagtacggcctcgtgcggtgcacgtatgccggaggctgtgccgtcaacatcaacctgatccccgaagtgggcgacggtgagacgaagcttgcctcgggcagttacttcagcgttcagcagaaggcaggcccggtggtcatcactggcgacgtgggcgtgaccctcgaagtcccggtcggctgcaccgccgcaactcgcggcaccaactccgtcgtcactgcaacgtgcatcgacggcgacaccaacacgtggttgctctcgggcgacttggctaaggagtaagcatggctaatcacttcaggctgtacggccgaccgctgatggcggacgaggttgcagatggcctgtcggtgacgggcgtgctggaagggtacacggcgggcgaggcttacgagtctcgcctgtccatcaacaacccagtcggccgctgcaccgtggaggtcatcgaatcgacgctcccttcgggcgctgcggtacgggtggacaacatcaccaaggaagtcgtcgtcaagtgggcggctttcactgaagtcgtggacgaggaaaccctcgtacccaacggcgacttcgaggcaggcgacgatggcacgtgggttccgggcggtggatcgaacggcgaaggctggtcgattggcactggctcggactacgataccgacagcggcgtatacagcgcgcgcttcgccaacatcaagacgggcggtagcgacttgctcaacccgctgatccctgccaaggtcaacgactacatccgctgcaccgctgaagttcagcagggcgcaagctccaagggcaaggccggtgcgcgcgtctcgatcatctaccgcaaggaggatggcaccgagctgcaacgcaactggggcaacatggtttcctctggcagcaacggtgcatggcaccagtctgtcgccgagggcgcagcgcccaaggacacgaagtacgtgcaggtggtcctgtccgcattccgcagcaagcagaacaagccgctgtgggtggacaccgttaagtggaaccacaagtatgtgctcggtcagaacgacgacagctcctacttcctgagcatcaaggtcacggacgggttgaaccgtgtggcctactggtccgggcgtatcgaggagcaaggcatctacgtcacgtcgaagctctacagcttctaccagttcgatgcagctatgctgaccagcagcttcgctggatacagcaacatcgacatgcttccgcctgttgactctgcgacgttcggttcctccttcgtgagttgggaaatccgtagctcgcgtcaggattacaccgccgatccagagacctcactgtacggaagctcgttcgtgtcgttcgacatccgctctatccgaaaggactactcgcctgacccggagacggcaaggctgtccagttctttccattccttcaccctgaagcagcaccctgttgtgaaccagccgcttgatgcgtctgcccagctgcggtctggcttcgtatcatggagcttcgcatgatccacaatcgactcggcgtagccggtgtgttcactatcagcaagggcaagtccctcgattcgctggaagttgtggcagactggcagaacaacctcatcactgacggcggcatggacgctatgggtgacaacggaaatggctacgcgcgcagcatgtacgacgttatcgcgtacttggcagtcgggagcggtagcgcgacacccgcgttcactgacaccgctctcggtgctcaggtggcgcaggtcgggcgcaccacgtcggacaacggcgggactactactgccccgtactacgcctactcgcgctgccagtaccagttcccggcaggcactgctaccggcgtcctttccgagctgggtgccaaggcgtacaacagcagcaacggcacctacatcctgaccacccgcgcactcatcaaggactccgcaggtaacccgaccaccatcacggtgctgtcggatgaaatcctcgtggttacttacgagctgcgtctctacatcgacacgactccggtggtgacgactgagacgatcaagggcgtcagcaccactgtgacttgcaagcccatcgccctcggccggagtggttcgctcagtgggcagtctgccatcgcgtggtcggactacgtgtggggctgctactatttctatggcggaaccggagacggtaccggcgcgatcactgaccagtatcctccgggaaccaacatcagctactcggacttgcagattcagtatgtggcctacgttgctggtagtcactatcgagacgtggtgtgtcgcatgtcgatcaacaacgttcccggtggtccgatcacggctgctatgggcctttctgcttgcgcctcgttccaagttggcttcagtccgggcatcaccaagaccggctcggagacggcgaacctgcgcatgcgcgtttcgtggagccggtacacgccatgatccccactgtctcccaaagcatccaacggggtgactgggtggagcagcagaatcggcgcacccgcccgctcatcgacttcgagcagggcgggctggccctcaacgcatccgtggacgaccttcaggctgcgttgtggaccgccgagagtgatggtagcagcgtcgtcgtttaccgcgacggcgttgctcctgtcaccgtgctgacggactcgggtatcacgcagatcgcactggcattcgaccagaccatgcgcccgcacatcgcgtacatggcaggcggcgtgtgcaagttctactggtacgatacggtggctgcttcgatgcagaccatggtgatccccggtgctaccactccacgactgtgcatggacgagaagcgagcaatcttcgccactcagagcgacgtgctgctgtcctacaagaatgggagtagcctgtgcgttcgagcacagcgcgagcgcttcgcaaccgaacacgtgattgccaccggaatccccggtgacctgatcgcggttggcatgaacaacgtcaaccgcctgcaatggaagctcgtcggcaatcccgacgactggccctaacctacaggagaacagcatgaccccgccgagtgtggtcaatgaggtcgtccgaacctcgccgcttacgctcggcgcggtctacctcaacttcatcagcacttacggtgctgccatcgtaactacgctcgccattctgtacgcagtcgcccagttctactggcgcgcgcgcgagcaccgcaagatcatgggagggaaggatgtcgaaccccgcaagtgagggcgcgcttggcgcactccacgaacttgtcgccacggtcctgaaggaacgcctcgccaacggcgagctgtgcaccgcagccgacatcaatgccgcgatcaagtttctgaaggacaacaacatcacggctacgcgcgaggccaacaaggccctcggcgaactggaagacgaactcggcaagcactcgctgccgcaggccgacgacaccgagctgcaagcagcgctcgacaacatcgtgaactttccggggagcgtagccaatgcgtgaatcagcttttgcggcggacattcgtcgcaagtgtttggaactgttgcagaaccactatcggcacttcgccgtgttcatgcgagacatcatgaaggtgctggggttcgagccgacgtggatgcagtacgacatcgccaactacatgcagtacggcccgcacctcgcaatggtgcaggcgcagcgaggcgagcccaaatgtaccatcgccgcgatctacgccgtcttctgcctgatccacgatcccacccaccgtgtgctgatcgtatcggcaggcggcactcaggcatccgagattgctacgctgattcagcgcatcatctgtgtggtgccgacgttggagtgcatccgcaaatgtaagaacgcgggcgaccgcacctccgtggatgcgttcgacgtgcaccactcgctgaagggcatcgacaagtccccgagcgtggcgtgtatcggcgtcaccggcaacctgccgggtaagcgtgcgaaactgctgatcgcggacgacgtggagtccaacaagaatagccgtactgccgcgaaccgcgagctgctgctgaccatcacgttggagttctcggccatctgcaccggcaagcccggtactcccggccgcatcctgtacctagggacgccgcagaccggcgactccatctacaacaccctgcccggacgtggctacgacgttcgcatctggcccggtcgatacccgacccctgcacagcgcgagcactacggcccgcatctggcaccgtccatcgtacagcgcctcgaagccgacccgatgttggcgttcggtggtggcccgatgggcgacgagggccagtgcaccgacgagctgttggccggtgagcagaagcaccagtccgagctgcgtcagcgcggaccgtccagctaccagctgaactacatgctcaacacgcggctgatggatgcgctccgcttcccgctgaagaccgagaacctgatcgtgatccccggtggcggcgaccgcttcccgctgacgatcactcgtggcctgagcaacgcgcaccagcgcagcttccagtctagcgggtacggcttcgtcatgatgatgccgcacgacatgagcaccgagactgccccagtgcagggcgtgcacatgcagatcgacccggctggtggtggtgccaacggagacgagacggccttcgccgtgaccgccttcctcaactccaccgtgtacgtgttggccgtaggcgctgtgcccggtggctacgacggtgatggtctgctcgaactccgccgcatcgcggtgaagtacaagccgaatgtcatcagcatcgaaaagaacatgggctacggcgcgttcgccaaggtgttcctgcctgtcctgcgagaagatcgcggtaccgagaagggatacaagggcgacatccgcgaggagttcgtgaccggcaacaaggaagcccgcatcatcggcacgctcgaacctgtcatggctcgtggctcgctggtcatgctggaatccgtggttgaaatggatcacgagtacactcagcgctacgcatccagcggaaagcgtcaggtctacagcctgttccaccagatggcgaagatcacgcagcagaagggcagcatcgcacacgatgaccgcctcgatgcactggaaggaagcgtgcgccactgggttgcgcagcttgcactggaccagaacaaggccattgccaagcagcagcagcgagagttccaagactggatcaacgatccgaccggcatgaaggcagcgacccgcaagagtccactgcaacgtggccgtccatccctactcgaccgttaccggaggtaaccaatgcagaagtccgacttcaccagcaactacacgggcctgttcggccgtggcaactacctgcaccgcgaactgctcgccctcgtggagcatgcagagcagcatcccgcaaccgcagcgcagctgctcgcccagttccagaaggacgcgaccctcgtgctcgacgccctgatcgctgccggtgcgcgcacgcagtcctcgggtccgaactccggcccgcacactccggtcgatctggacccggacgatgacccgctgaccccgtaaggagcaaccatgaaccagcagcagaaccaagataccagcaacaaggggctgttcggcctgatcggcggcatcttcatcggcatttcggcaacgctgctgtcattcacccaaggccacgaaggggtacgctacgctgcgtacctcgacaccggccgggtgccgaccatctgctacggccacaccaagggcgtagcgatgggcatgacggcaacgaaggcacagtgcgacaagtggctgatcgaagacctacagatcgcccagaagggcgtgcgtaagcacctgaaggttcccgttaaccgcaaccagatcgacgcctacacggacttcgtgttcaacgtgggcgagaaggcgttcgctgatagcaccatgctgcgcaaggcgaacgcaggggatcgtgaaggtagctgcaaggagttcctgcgctgggtctacgtcggtaagctcgactgccgactgtccagcagccgctgctccggcattcccaagcgccgcgacgcagagtttgccctctgcctgcgccccaacaacgaggtgatccaaccgtggaaaccccaagtgaagtgatcgcacgactcggcggcaaggctatcggcctgctgctggtcgtgaccatgttcgtgtgcttcggtctgtacgtctacggcctgcaacgcaaggtggagaagctggaaactgcccaagtcggcacgaccgctaccgccaaggctgcgcagactcaggctaccgggtacgcaacctacatcaaagagaaggaggatgtgcgtgttcgcaccgaagaagctctcgacgccgttcccgagtatcgtgacggcactgttcctgctgatgtcgctgacctcctgcgcgaacctgccggttcccagcgatgatctactgaaggactgtcacatcacctacctcggtggtgagcgcggcacgtcttccagtcaggacaaggtggtcaagctcgcgcaggaccgccgcatggacaccgttctgtgcaacaaggacaaggccgcgctgcgtgcgtggaaggaagaagtgtgcggtaccggcaagcgccggtgtacgggggacaagtgaccaccatcgcgtgggacgggaagcacctgtgggcggacagtcaggccacacagggcgaccacaagcacaccgtccgcaaaatcctccctgtctcgacacccaccggccctgtgctgctgggtgtcaccggggatttcacagtgcttcgcccggttctcgctgcgcttaaagcgggcgaagggtacgaggagcacgttggcaagtccgccacggtccttgtggttaaggacggcgtactcacggtcactactggtaagcagcagtgggtcgaggaggctccgtacttcgatggaagcggcaaggcgctagctctaggggcctatcatgcgagcaagtctgtggctaaggccatggctgccgcgatagctcacgatgtgtatagctccgggcctatcatcaagctaaaggcaccagttcgcaaggcttagtcataaggccacgtggatagccggaccaaaatttgcttcggaaatgcgcgggggtcactccaatagaagctcccgcgcgtgcccccatacgcccgtgcgttacgcgcctgcgggtgcgcccgcctgcgtgctcgcgtgtgcgcctgtgtgcgcgtctgtgcgcccgcgtcaaggttccgcgtgggtgtgtgcctgtgcctgcctgcgcgtggcgtgtgggcgcgcgtgtggcgtgtgcgtgggtgcctgcgtgggcgggtgcgcggttccttcctcgggctggaccgtgccgccttggctgaatggttaataaatcttccgcgattggtgcttgacggcaggtcgggagtgtggtttcatagcgtcactggggcagcgacagggcctcaggagggccgcaaggggcttgacaggtgcatacctacctgctaccatgcgaaccgcagctgtaggcgtgtgagggccatctgtatcgtttcggccttttggtacacctatagcacacagtgccgtcgatcctgaacgccgagctatcggtactctgtcgaggcactaagtgagccacccgctaggccaacggttgacaccggccctgcaacgtggtaagctgattcggaagtcgagtgatgtaggccgtagtggcgctgccaacaagcgagctaagggtacatgggtgctactggaacgggatgcgaggagctaccgaaccacac

SEQ ID NO: 25 - DNA, 20 bp, Artificial sequence
  Primer
tcccaagagtgattgtatcc

SEQ ID NO: 26 - DNA, 20 bp, Artificial sequence
  Primer
ctgcgatacagttctcaaca

SEQ ID NO: 27 - DNA, 20 bp, Artificial sequence
  Primer
caaaatcgtcatctacgaca

SEQ ID NO: 28 - DNA, 20 bp, Artificial sequence
  Primer
cttttgtttggtttttgctt

SEQ ID NO: 29 - DNA, 401160 bp, Myoviridae bacteriophage
tgtccaggcgctgatccccgaccgcttcggcaggttccccgatgaaccggaatacgaccagtcgaagcaagcccagcccatcatcaagtagaataaccagctgtgaaaaagcccaggcgatgaacctgggctttttcgtgtttccaacaatcagcaagtagcgcgactgatcttcaactgtcctgcgagtacgcgtggcgcaccgtcaccgttgttaaccgtcttcgctgttgcgagtgtagcaatgtagagcaagtttccgccggtttccgcatcatacagtcctgcacccgtaatggtaccccagtttcctgttggcacgttgtaggtgacgtcggctgcattggaccattcctgattggtaccggaaggaccattccacgaagtacctgttgaaaggatctgcttacgtccgtagcctgtaccggaagtgcttacctcgacaccacccgtaccagcaaggctaggcacagtcgtgaacagggcaagccaaaccgaagtaggcggagtgtacgcagttcccttcaggaagtattccatgaacttgttgaactggtaattggtagaggtcgagcttggcattataaaagttccttgggttgtctcttctgatatttacagccctgtgatacatgtcctcgcatgtgtggacaccgtattggaccgttctgtataatttgatttatcagaaagaaaagttagaaagaaaggtgcctgggtcaagaaccagctcaacccagagtttaaggcatgccttgatcaattgagattgatcatcattgcacgaatagccatctgagtagctgcaccgatggtcattgctccaccagctgcgatagacacattgcctccggctgccaacgaataatttccgttcacgatatctgtcttgttaccggatacctgagtcgtgcaatcaccattgactacgactgtcgcatcaccaacgatgttgacttgaacttttccttctacgtgtaggtagtcatcacccatcacgacacggtagttgtccttgaccaccttatcgacattggttccatctgggtgtacttccttgaacgtgcctgttgggtggtactgatggaatcgttccttaccgggtgtgtcgtcgaactcctgcaggtgacctccttcggtctccatgatcttgttcaatggatagagtggtgcagccatagtagtaggctccaaccatccgttcattgatgagatagtcgtacccagtgcgcggatggcaccgaggttaggaatagatctcgacaggccttgaatcgtggttacaatctttccgatgtttcctgcattggtgatggcatcctggagacgaccgatctgtccgatcgccattggaatgctctggatagaactcatcacagagtcgaagtcgagtgacttgattgccctcactgcggcttccacatcacctacctgattctgtaccaactgtcttgccagtgcctcagggtcgaggttcttcaggttctcgatttgtcccttgatcgcgttcacttcgccttcaacctgggcttgcagtgccttagcctcagatgggagtgtggcgatctgtgtcatggtagatgagatattgttcaacccagccatgaacggaagattcgacagacctgcgatgttcgagaactgatcacgaacactattcaacttagacttagcatcctttacagtcgagttgatcttgttcgccatgttggtggcagcagacagtccactaagagcattgctattcgccaaggacatcttgacggctttcaccttctcagcgatgacggtctgtccgaggtcttcaccacgagcaagattgttcgtatcaggcttccctcctggagcacctgcgagtgtacccatgatgataggagtctgagcattctttccgtcggcaaagaacccaaccacatgggagccttcttgaatacccgtaggagaagaacctacaccgcccttagcggaagaagtgataggctgcataggcacagcccatggtaggtcggaagtcggaatggcttcgtcatcatagtagccgaatgcacgaacacggagacgacccagcttctctggatcatttctatcctcgacaactccgatgaaccactcgaaggcaccgccaccgaacgaaaaattgtgtacttgcgacatagaactctcttattggtatatgtaggtcttgaccgagtaaacagagcagcggtacgcgtgctcagtcagctgttatgcttcctcgagtctcttcttgaccagctcagcgttgatcttgtaggtgtctttgttgatcatgtgagccatgtgagtgatgacatagcgtccacggcgttgagtatcgaactcttcatcggacatagagtcctgagcaggcaggtccacatcaacggacttcgcgaaccatctagctgcacctgccgttcctgggaactggatgatcaacttgtcttgctcgaacttcatcaacgaagacttacgggaggcaatccaggcatcggcggtatccgaatacgctgcattcttgaacatgccactatgcttaggaatgaacgaaatgttcgcatcctcggcatccatgagatactctgagtctaccttcaggtacttcttgtcctgcgcgttgtcatcaccaaacttgaacgtctttgtttcccatgccttagtcttgaagtcataagacgcagtctttgaggagtagtaacctgatgcgatgttactcagtccgtcgaagtggtcaaaccaatagacaccaatggtagtggcatagtcgtagagcgtatcacccttgttgtcctttagattggctgggcgtacctggaacgtgatacccgagtactccgaggaatcggaatagagcttctcaaaggacttgaacgcgaagtccccgttagcctgctgatagaaggcatagtcggcagcgccatcctttgtggcagtctgcaacaaccacgacatagtatggaacggagtccatccaggcacgatcatctgcatcgtattgtcggtagcatcaacgtctaccttcttaccaaaggcttcacgaacaacggatgtggcaatgtccgagaccttcttacctgcataggatctcttgatacgctttgtctgattgagcaggaaggcctcgtcggctgcatagacagagtactccaacacaccctgggaactagccaccttatcggcgatcttgtagatgacgaactcccacgactgttcaccatcaccaatagacgccatctcagtctcgatctctactttgatacgagtaccagaacggatagggagagtcatcaacagattcgatgtatcaaggaagttcacaatggcagtagtcgtaggagagaagatctcctgaaagacatgtgcactgatcacagcctgcgatacatcaacatcgccaatggtgacgacaaacttcttgaggtcaccatagttggcactagtcgtagcagtggtcatacttttccttcaatgctcttattgaacaagtctacaaattggttgatatagcgcggagccacaatgacgatctttccacgcttacggttcaactctgattcggcttccaatgcagtcacaggatgaacattcgcaggcatagggttaccggcgtcaatataggcacggacagctgcctcagccacatcgtcaagtcgatagccttccaagtccgtgaagtagacaatggtattcaggctaccatacttagcaacaacgaactcctcgagtacggaatcatccataggccaatcgagcaacggattcaccataccattgacaaggaagaacacccaacacagagtagggtccttgtagagctcatatgccaacgactccgcactcgcaccattaggtacatcataggactgatagacataggacttgtccacgttgatacgcttcaacaccgccgcagtgacgatgttcatagcgtccttgttgtacccatccagtgtatagctgagtacaggaaacttcttgaagaacgatggcatatcagtaaccctccacgatgtcttcgcgtgtcacaatctcgagttccttccacttggttgacattgtgatctccgaagggaatccgtttctcatagtagagaacatgccttgtccagtatagtcaatgtcgatagacgtacagacggaacgcttgaacttttgaatccactcgttgtcctttccctgccataggtaacggatgtcacactcagatgggaagttgagcagtgctttgttattgcctgtccccatagagtccttactatatgaaggcaaggcgttctcacggaagacagagatgatgtcgtagatgtcctggcagtcttcttctcggaatggatagaacttaaagacgaatgcaaactcacgtagaccaacgcctttgaacagcgcagtcacatacgggttcgggatcataccacccacggcgcccattagtccttccgcagtaacgttaccgcccattagaccagcggcagcacttccgaggttggcaagtccataggcgcctgcgagctgcataccatcacctgccatacctacagcgtccccgaatgcctttccgatatcgagaccacctttgagtcccgccatcgcaccaccggcagctgatctaatagcgtttccgatgaacccgaggtttgagtcgccccagtcaaccgtagagggctgggcaaccgattcgggcatatacagatggaccgtattcaaaggactgctttccctaggggagcttctctcaaagaacttgaactcgatcgcagctgggtgtactgactcgtccgagaggtcaggtgggtaactgtatagcgttttgtttgatcgttggcgtgccacaatcgtatgcctaaatatagaagtctacagatatttaatctgggtgaaaaggcaggtgccttcggctataccgtttctttcacaggattcttagcctgttttcaaccgagattatcaacttatagctgaatccctatgcagcttcctaaacgagtgatttaacaatggcacgcaagtatcaacagggtcgctatcgcctacttcatcctgaaaagtacgtaggcaatgctaatgatgtggtgtatcgttcttcctgggaacttcgcttcaatagatggtgtgacctcaatccttccgtagtaaagtggaacagtgaggagatcgtcattccctattattcctcggctgagtgtaagaaccgtcgctacttcgttgactatatcattcaattgaagatggctgatggttccttaaagactatgctgattgagatcaaacctgagtcccagactatcgctcctacaaagggaaggaagaagcctgagcgttatcttgaggagtgcgttacctatcaggtgaatcaggataagtggactgccgcgagggcctatgcagagaagcatggcatggaattcaaggtgatgaccgaatacgatttaggcattgccaaaaggaagtaacatatggctactgtaaagaagactgcaaatagaacgagcgcacagcctaaaaagaccattgagcaaaagctgatccttcatgatcgtaagcgtacgcagaaggcgattgagtggttctataccatggcaaagtccaagctcaagcgtgcgaaagttcctgaagaggcctttggtgccaagcgcaattcatctaccttcattggtggcatgtttatctatacctacgatcctaagtacaaagatgtactgccctggtatgatactgtgccttgtgtgattcctgtcgagatgtattccgacggatggcttgggctcaacctgcattacctaccacccgtgatgcgtgcgaagctgatggataagctcatcgagtatcgtaagcgtgccgggaccgacaaggcttatatggctgtgtcctataagctccttaagaacgtcgtgaagtcaaaatacttcgcaccatgtgttcatcgctatctcgcatcacacgtcacatcgcgtttggtacaggtatcggacgagtactgggaagaggtagcgatgcttccactacagcaatttgagaaacaaacagcccgccaggtatggcgtaagacaggactggcatgagtaacgagaccctttatatgaagttcctctctcacttccaacgtggagtgatgagaccgaacaagtaccttatccgattcactctacccgagggtgttgcaggcagtgctgatttcatcgatcagcgcgtacgccgcggacgcctacagatggaggaagcccgattcaatggcatcggttcgatcaacatcaaatgccacacggctaacttccctcagcgcaatctggtgacgagtgaacgcgcacagaacagctcatcgttccgtgttccttatactcaggcatacgatcctgtgacgttctccttctatgctgatgctgatgcagacacccgtcgatacttcgacctatggcagaacaccgtcatcaatgtgcgttccaacacgctcaatttctacaacgagttcacagccaatgtggagatgtggaacttgaatgagatggaccagccgacctatggtgttcgactcgaggaggcttatccgattgccgttggtgccatggacattgcttacggtaactcgggaacctatcagaccgttacctcgacgcttcaatatcgacgttgggtacagattggttcgagtgccgacaatcaaagagcgcagaactccggaaccaatctcggcggttgatgcttgcactaaagcccggactcgtcacccgggctttttcttggttagtggttgacgcgaatcgtgacccagttccttgccacctcgcccatcacaaactcgttcttcagtgcgagagcctcatgaaggaatgctcggcggtcctcaggactgactccttgagactctagctccctgctgactgccttcaccaattcccaatccgacatctgtcctgctaccactgcaattgctggatacttgggctgcatgactctcacctcacaatcttgtcctgtttcccccgattacccgactcagatgccgggcaccttgagtatacaggatcttaacaggagcccacaaccacattgctgccagtcgctgacccgtcatctgtacgagccctgattgctggagcccaatagaatcagacacttacgtgcctgcccttcctgaccagaatgctagtaatatcaaggggttactggatcagcgcttaaaagctgggcggtccgtagagtcattggactgtggtggtccgcttaacatctttttaacatctataggaataggttgtcccaggagccttcacggctgtagcatccggtcatcggggacaaagaggtcctcggaaggctcattcacaacaggagacataccatgaaggtattgcagcgtgacattccttgtgccgtggttgcccgttatgacgatggcgatgtggcggcactctgtatcgagatctatgactcgaaggaagtacggattgtctatgcaggatcggatggtcctcgatacattgagatgaagcgcatcatcaagaagggtccgaagttggacctggatgcaatggtagccgcaatctaaaaacaagcccaggctcatcacctgggctttaccacggttaaatatctcatcctacaaacatgtgatgcgatatggctcgtacaaagaaagtgattgagtgtgatccctggtacttccgtggtgagcctttccctgaggaaggcgctgacggctatgagggctttgtctatctgatcacgatgccgaatggaaagaagtacattggtaagaagttcttcaacggcatgcgaaagcagaaaggaaagaagcgacgctcaaaggtagcgtccaattggatgacctacttctcttcctcagagtacatcaacaactatgtgaaagagaatggtacaaaaggaatcaggagagacatcttgtccctccatgagctcaagcgcgatgtgaacttctgcgaaatcctataccagttccaattcaatgtgcttgaagagaaagacgccaacggcgagcgtgtctggttgaatgatcagatcaacgggaagtggtggccacatcttgtgatgggttggcgcgaccgaagcgatgtatgtctgccactttgagtgacggaaactgcttctccgcatcgcgagtgttggaatcgattttgacatagagatgcccgttccaattccaagcgatgtgatcgtagtacttcaatgctgcatcgcgagcgtcgtatccgcagaagtctacgtctgccttttcggcatcatcaaagcggacgatatagcatccgtccgaaggcagctcaggatagtcagtggctgaggcttccaactcctcagccacttccgttttgcctgcccgaatcagcacatcgagtgccatgcgcagagcgccttgatcgacgactaccttactcattggtcactacctttcggcgcatctgtttgattgcctcggcaatttccggacccttgagcgatgcctgttgttctcgagacagttcagagaagcccagtgaacgtgtgcagctccaggcaacgatcaggtcgttgaagaatcggctgcgagccataccaaccttgcacaggtcacggatcattgcttcccatacctcaggctgcctgtaggcattgatcatgtagagaacatcgacctgattgctgtccagtcggcagctctgcagagtgcgatacattctcgcataacggcgccactcgttcgacacgcccatcctgtcttcgacgttgagcgcatcttcctcagacatgattgatgcgatcatggcatatacgaatggaacagagccgccacgagcattactgatcagcctgtaatcgatcttgtcgatagacagctcgggaatgatgacctgtagagctccgaacgattgcagcgtggtcaggaacagctcaggttcgggttcaccgaatgccttttccatttccaacagcacacgctcgcgcgtcagatgagccaggtcgccacggcgaaccatttccccgatcagtgctttggtatcatccgcgacaacccaatcaccgccatacctggcacggaagcgagcaatcctcagcacacgcacaggatcttctgcaaaggcaggagagacatggcgcagtaccttggctttgatatccgcctgtccattgaacgggtcgaagatttctccggtgtactcgtcctgtgcgatagcattgatcgtcaggtcacggcgagacaggtcctcttcgagcgagacatgctttccgtggtcagtggtgaagccgttgtaaccgacgcctgtctttctttcgatgcgcgccaacgcgtactcgacgccttcctcgttgataaagacagggaagtcggcaccaacctgtttcagtcccatgtccagcatttcttcgggagtggcaccaaccacaacgtagtcgatgtctttcgggatctttcccatcaggctatcgcggactgcaccgcctacgatgtagattttcattggttgagagccttttcgagtttcagaatgtcttccaacatcttgctgcctttaagtttcactgccataggcgcaggaatgctgtttccgcttttgatccaggctaccacttcgcgagcacggctttctagattatgcaagcgctcttctgtgttcatggctcagtgcatctttctcttgagtgaggagttcacatgcagccttccgccgcagtgttggcagtactttccttgcggctcggggaccatcggcataccaatgcaatcctcagcacggatatcttccagctgtccgcattcggtgcggtaggtggcatagtagccatcaaagccggtgatcctccagaggcatttctctgggcgaggagggagatagtcctcaggaacaggacgaccacggttcatgatgttgagatgatattcaatgccgaaatcgttttccatcatcccttcctcgccttcacctgtaccactttgaattcccaatccgtcaatcggtattgctcattataacggtcccaccattccatctcagcctggacaccttccatggtttcggaataggaaccggcgacctcagaccattcttttaccatgggtagaggactggcctggcggcgatgatgaagtacgaaaggcattacgccaccggtccacccaggcgaatagctgcatcagcgatgaactgcaggagatcatactcgctcaccacacccaggtcgcgctcggtgatctccttgatctcgtagaagccaggcatgggctgactcacgagcaggcgagtgcaaggacgaaggttgatgatgcgatttccctgtgcgggattcgagccagcctcgcgctgcttctgttcgtaatcagcaatgtaatgctctactacctgcttggcttccaggagacctgcaccggtgttggcgcggaaagtcttgatggcctcgacctttcggttcggctgccgtgcctgggtcttccagacagccgactcggggtcgctcgtgacacgataggagtaggcgttttcgatgatctggttcatgtctgtttccttacttggacagatacttcgggaggttgtagtcgagatagcccttcggcttctcgcacggcttgtcgttgctgcacggaccgaggtgagtgcgatcaaactgcgtttggttcgcatactgctcagccgacaccgtgtccttgtaatcaggccaggtcgtcttggtcaggaagaatccttcttcgacgatcggcttggcgtagggtctcgtgtcagccactgccacaaccgtcggttctcgcagttcacgaacgagctctaccgtctgaatccacgggaaggacacgacggcatagagaacgaaaatggctcccatcttgaaatagaacgggtcggcgttgtatttctcgcgtacattcttgaacagcttcacagtggtgctccgtttgtcgatataaaaattgtacagataattcctttcttgtgtggacgaaaatcagccaaaagaaaagctgccttcttacgggcagcttctctcagaaactttcgtttcagtgcaacgtgttcttgcgcgttgcccgcttgacggtcttcttggctgccttcttcgcaggagcctttcgagcactagcacgcttcttcgctcgacccgtttggttggcgctcggattggccatgatctcttgctcgctgacttgcttgatccgatcaatgaagaccggatagtagcgccctgtggcaggatccttgcctatcacgaaccggacttcctcaccaccgcggtcgacatgcatcttgcggacggaattgacagcaccggagggcttggcgtaggtgtgggcgggagagatgagcgtagacatgacggtgttcctctgtggttggtgccggtccagaaagtttctgccagcacctgcattatatagaccactcgttaagacgatgtgtaggccattttctcaggggatatagaggtaggagccttccgggatgtgcacttcaacacgcatcatctcgtgtccccaggcatccgtctgcacacgaatgtaatcgaaaccctgggtgaaggtatagacgccaaccagctcaccggagtagtcaggttggccaatccacttaccgcagtgcatgttcatcatctgaacagcggtgcgatgatcaaacgatgcagtcttgacgtgttgctttcctaccttgacccagagctcgtacatttcaccctgcggcggaggagcctggcgcaacaccggcttctggcgattgaagaaacgactgagcatcacatgtctcctgcgagttcgatcagcttgttcctgcgcttgctcttctcctcactggagaggttagcccagtactcaccgccatagagctgtgcggctgctcgctcagcgcgccaccagagtgctttcttgagatcttccgggttcattgcttcttcctcacgtcactgccgaaaactgcttccacacgcgccataccatccttgagcttgcgataggcgcgaccatgttcgtcgttggggctgcacgagttgtccaactcgatatcgaggcggttctcgaactcatgccagatggtcctggcttctcggatgttcagttcgacttccaaggatcctgcctgacgcttgaagcggagcttcttatccaggtcggtcagttcctcgatgcggtcaaacccgtagccttgggcgatgtaaccctgcatcacatcgccattgtcgtcgaagccttcctccatcaccgagaccaggaaggacatctcaccccgctgccacttggtcaggcgaaccttattgacggaggaagacattgcacatctcctggtagtaggtcccgatcagttcgatatcggaaacgtccatcggaacatcgtgtcccagagcacggcgcgccacatcacgatacaccatggcgcgctcggtcatgttgttcttcgggtccatgatgaagtgatgggccttgaggatcttcggcatgtccttgacagcctcgccggtgtactcttgcaggaggatgttctcgaccttcattagaagacatcctcgaagcggtagatgcgataccccacatccagcgcaattccgatatcgacggtgagtcccgagaagcctccgatgttgaaactgtgcggctcactcaccacataggcagatgcgccacgccccttaggagaggtcaccaactgcatctcgcccctgttgaaggacaggatctgcgcgaaggtgccggcgtcgatctgtgcgacctgctcaccgcccttggtgaggatgacaaactgcctgctcatttctgttcctccagcttttggatgattgcatcaatcagggattcgtcgaggacatactgcttcgggtcaatgcccaaaccgatggcgaagtcctcgagctcgctacggtctttggtatacagccaggcgttgtgttccatgatctttagtccacgcaatagttggggaccgaaccactgtgcatacattcggtcggggtcgtcatccacagcgcaccgatggtcagtgccacaacgatgccaatcagaatgttcctggtcttggtcttcatcagatgttcctctcgtaggtcttgacgatgtagacgcccttcggcgcaggaatgatcttcgcccgggacatgaaccaccttccgcagcagtcccaaccgttcatgcagtgaccgcactggcacccactgcgctctacgatgccggcatcctgcagcttgcggatgaagttgtagcgggtcttcctgttcttcaggatggccttgcgctcacgtgcgttgaggctgaccaggatgtgccgctcgacctgctcgtcatggtatcggtcgatgtagaaggtcttaccgcccaggatgcgcatcttgctcatgatcgtctctccttacatcacgcagaatttgaagtgaacgcctgcctggattgccgtttcgcccaggaacaccggatagaagcgaccatcggtgtgcgtcatgatgacgtatcgcagcggactgtttcccacaaaatccggaaggtccaacttctctactgccttctgagcattctcagcggtcttgtaggtcttgttcggttccaactgaacttgcttggccatgtctgctgtcctttttccgtttcgggctgtatgtttgccccacaaccacatattaaagactttcgtaggacaggacaatcttatagatcagacacttgctaatctgtttggaaccaagaatcagacacttacgtaggaaacccagagaaccttgggttacaagggctctgggtctcaggggttttggtacgaagtggttgcagaggttctggtcttacttttcctcagtcgcgaatacgaatgcgatctgactgaggtcgatgtacagcatctgttgaccttctgccagttcccactcgatggcggtgacacgatcgccatcatacttcacaacgaatttcttgacatgaggaatagctacaggctccgagctgcctttgaacagaatggatacagtgaaagtcattactcttcctcgtcgcggaaattggggttgccgattgaacggagtgagaaggtgctgagatagtgctgacgatagaagtccttgtaggactcgtcagagttctccgtaccacgcgctgcacgatggacgaacttggccaacttgccacagttcttctctacccagtctgcgcgttccttacccaatggaatgctgctcgcatgtgcgcccaggaaggcaaccgtctccatcaggttggttagtccttcagtcacgcgccgctcgatgtgatagatggcttccatatccgcttcgcctgcgagcagacttgggatcaggtcatccagcttctcttcgagtaccagggtagcgatatcgcgctcacgaatgtcgatcaggtgatggcgatcgcagtaccacttcgtcttgaccttgaagcgaccttcatcggtgtagatgacccagccttcgatgccctcgatggtctttgccgactcgaggtagtcgtcaaccgtcaggccctcattgtggtcgaccacaaccgagatgccccaggtctcggcgattgcggtcaggtccgaatatgatacgtaggaaccatcaaccatatctcgcatcgccaacagaacaagctgaggcgtctgaccatagtcgaggacgatcttgcaatcaggatcggtgtattcgaagatcggacagaagttcagttccaacatgctgagacagaaccgctcaatggttgcagtcagcgccttctgagcagccacagcgacgtcggaagtgaaagtcttcttggtcttgaagtgaatgtatccgtcgacgtggatcggagtgatcatcgatccatcgcgcttgtccaggacagcctgcaccttgtagtcacggatgatgtgcgcctgagtgtgcgccttctcgttgacgttgaagaacttctcgaatggcagcgagatcagcttacccgtttgggcgtcgaaggtaatgccacggcattccacgccaagtggcagcttccacaggtcgtcggtggaaagcatgtaagagatgatgacgacatcccgaccggcgacgttctcctcgcggaaacgaacgttcgggttttcgcggaagtggtcaaagtctgacaactgcagatacattatgaagtccttgggttggtcatgatcgcatgagcgagagcatggtactcacggtgatacatttcttccttggccagctgacctttctttcgtttggtcagctcattccaattcggattgttcttttctgcggtctcccaatcaatctgttctggcagtcgcttgggcatgttcttatccatgaccatagtctacagagaggagtagaaagaacaatcggtctcttcaccgttattgtagaaagttgctcggtcaacgcgtcgcatcacatcttgaagtttctcacctgtgatatcgacggttgcctctttgccgagccaccgcagtgtcgtcgaaagagtatgggctcctacgacaaacactgcggtatcaggctgcgggtggtagtgcatctttcgctccgaagaatggttaccaacttagactaacaggtcaacgatagaaaatgtgatttccgattcgtgccgttcggttgagctttcgcgcccatccaggattgattgaggtgttgtggaagtgagttgcaccattgaccagatcacggagcgtacccgtgagcgctttcattgcgatctcaccggcgagctcccaagcccgaatctcggactcttttctaaggcgtggacctccgctcttgctgctgtcgcagaaccaagagaattggcaggtgcccctacttttctgtttgacgacgccgcaggctgtacttggatagcgactgtcttgagtgcggtgcatggttacattagcgaccgctgtcattccgctggtgccctgacctcgggcttcgtaatagatatttttctgcaggcaacgaagctctgcttcactgggtagagcagcgacaaggatgtctggctctgcgaggtcaggtacgaaagtgtgtaccttgatggatgtatccacgacaatctctggcgctggtgccaggattacttcgggcatgatgatcgtttcggctgcgtgtgtattgaatgttgaaaaagttgaagtgatcagcagcagaaacaaaattacaaatttcttcataatctgtctcctttacagtgccgtttagggtaacagaaatgttacgccaaacaaccttgtattgtgctcagaatatttctaaaatattcaattttgagtctgggttgagttgtattgattcgattgaatcaggcgaacaaagcggaaatgtcgccccatacgacatctgcgtcatcattataagcttcgatgtctctgctcttgtagtcggcaggcagagcatctcgaagtgcgttgtagaccagatgatagctggtccagttaggctcgtcggattcgagctgagccttgatcagtgctcccatcatatcccacttgacagcatcttcattgaagggagagcatggtagaccatcagctttccgtgcaagggcgccctgtgtccaggaagcgccacctgcgaggatagctagagttgcggcttgaagtgttgcttgagacatagcttagcccttgagggattcgaacagcgcgtatgccttctttgttgctgcaacgcgtgcttcgtatccgttaaggccaccattgatcttgcgagtgacctgttcatacgagttagactcagcgagtgagttgagtccacgggaagaccagaaccaacctgcagacaatgctgcatctggaagctgctcaagtagagcaggattctttacaaggcgatcgtcgccatacagagcaagcgagcaggctgtgtagttggagcgacctgtgagctgcttgaggccacgaccaatgaacgcccagccgtcaccttccttggaattaccgaggttgttgagaccccagatgccaccatagaggatgttggcgagtgcctgttggtttgccttttgagtcgcggtgcgaccgtacttcttagcgtcagcctcagagatacgagaacggctaaaggtcttcatcactccttcgacagagtaattcagcgactcgcgcagtgtcttgaagccacccgactcaacaaaaatctgtccgaggaagtgtgacttctgattctgagttgtaatgccaaacttgatgcaggcatcttcgagtgcctttgcgatatccgcaggtgcacccatcttaattgctacagtttcagtgctcatggtcacttgattacctctctccagcctcgatcgagttcaatgaccttgttgcagtggtcacgatcgatcttgttcaatactttgcaaaggaagacacagaattggcaagacttcgggcggttagctgtgatcttgccaattcggctgctgatcgtttcatccgggtcaccaccaaacactgtgttgaaaaactgatcaatggcgatcagcatgttccagacataacgaccaacttttgtcttttgcatctttactcttctaggatatccagcatgtctaggatagacagatcagttgcggagagatcaaccttctcgaggtcatcgagtttgattcggctctcaagcgtaacttcaatgtcgtgtaggtccttcatctcttcgatgaggtcgttcatgactgcatcttcgatcttggcattgcctgcctcatcgacgatcagttcaccgttctcatccttagcaccaaacttggacacgatcttcatgcgcaggtcttggtaacgctccgactcaacggtcacagccttctgaatcttgctgagcttgtaggcaaccttgacaggtacctgtgctacgaatagacggttcagcagttcaaacacggctgggttttggaatgcggcaaacttcattgggtagactccgggcgatgtatcattacgttgtccattatttacaggcttagatcggggtaccgaattgcatgtagaactggaagctaccgttgaaggttgaggcaccatcgctgacagtgtagttcactgtaccgtttctctcagcgttggttgcggatgctgttacggtgatctgcataccactacggctgatagttgcaggaccaccactggcaaggctcgcggcagttaggctgtaggatccagtaccaccggatgctgtaaccgttgttgagcgagatgcagaaccgtttggtagacgtgatgcgttgattgaaggagccgacgcggtcaacggatttgcgccactagcgtttcggaactgtgacaagtagatagtaccgcttgtgggaacacctgcgtttgttcctgtgtttggaactcgcccgccgccgcgatagtactggctgatatagacaggattgctaccaccaaactcgttacgaaggtctgcaaacgagattgcacctgaacctggaattggcattagatactcgctttaggttctagaggaatggttccgcccttaagtgcatcttgggcgtcttgattgttgagacgatcactgaatacctgctcgaagtatgccttgatcaggaccatcagaacatagccaggcgtttcacctgaggatgtcacgatggtcgagttcatgatctcttccataggaacaatcagcacgccttggatgtccgcagagttttctcttgggcgtagacccttgtgaggctcaagacccttgtagacatcgttctctgtgacctggtcttgcatgaagaacgttacttgtcctccattggtgaccgggtcccattggatttgaatatttggagcaacagtctcgcggatacgagtgatgctctcttctcttacgactcttgaactcacagttgagcctccaggtattttacgcgacggcgaaggttctgtacttcggcaatcagaagcggaacagtctttgtccaatcaatggtcaagatgtttggcttcatagggttagggttgtctttggtcttgatctgattgtgagcttggttgactgcgacagcgtcagaatagacagcttgcatctcctgagccactgcaccaacctcacctgtacgaggcttgatacctaccttgtagagtgcaatcttttcctcgtcccagtcaaactgacgaatgcgaacgttctcgaagaagtgttctacgatatcgtttggtgcatcaacgatgttcttcttaaggcgacggtcagatgcataagcaatgatgttcccctgacactgccattcattggctgagtttcggaaacatgcccaagcaaagttgttgtgggccaggaatccatggttaccatcgttagcgtggatccaagatgtatttccgttgtcgctgtcccagatacggatcgtgggtgaggtaccctcgatgttgatttggttaccagtgaagtaccattggtaatcgttcttgactacaacagatgatcggatgcctgtttcgtttggagcgccgcaaccaatgtacatctgccctgaaccgaggtacatgccaccgaagtagttaccggaaccagcattgtccctcagaccgatcattccaccgtagttgcctgttgtgagcaaacccgcagtgttgaagtcgccagggttagatgaaccacccattgaaatcaagaactgcgaattcagcgtggaatatgctggacctgcgcctagttgcagctgaacgccattgttacgagctgagatgtagagtgcaccattggcatttcggttgacgatgtaaccgccacggtctgtaccggtgttgatgccggaaccaatgtcaacacatgcaacatctttgttatcatcataggtctgtaggtttcttccgttaccccagacacgtacatgtccatcaacggtcattgcaccgtcggtaccaagggttacctgtctggaggcgttgtccgcaccatttggtcgtaggtagacaacacctgacgatgcagacagaactgcaacggcatttgaggaagatacgtaccctgggaagattactcttcctgtggtgaacgtgaatgatgtggcgcggaattccatcggcgcaaaagctgaaccatcagcggtgatgccatcaattcttacagctgtggaagtatcaggattgattactcggatcttgttaccagtgttagctgtcttacctccgagatagatctgatcgcctcttgcatggaagtttccgttgacaaatgtcaaaccgtttagagaaagattagttgaacggatgctaagaggagcatatgcactattcgcactgttgacagcatcaatggttacaccggagattccctccgctcgcatgaaaatctgatcgctggttccagagactggctggatacgaacagtattagcatacaggtcaggacccacagcagctgtgatagtgatattggctgaaccatcgaacgccacaccattgattgtgcgagccgttgctagtttcgttgctgtagctgcattgccagacagagaaccactgaacgtagacgcattgatcgtactcgtggtcgggttcatcgaaatgatgttcgtgttcgcagcattagctagaacaaagtctttggacccagtgatatcgtagagctcaagttgagcagttgaacctgttcctctctgtcggaactgccatgatctttctgtgaccagctcaagaaggacagcgccagaagcattaggcgttgatgcgcctgcacgaacagttggcatatccacatttccagacgcatagaacacagtctgaaatgaggtgcttgtatcaccatttggtcggatatagacgaaaccacttccgccagttcctgaggataggacgatgctccctgtgtcagtgccgcgaagagttcctccgccaacaccgatcaatgcaatcttgttgtttggtagagtgaacgcgccgttgaatgtctgcatctgattccagacattcggtgtagtgatcaggttgttgaaatcgttgcgcagttcatcaatggatggagcataacctgtcgtgatagaaccaatctgcaatgagacattgccaaactcaaaccactggtcagcggcagtgttaccgtaaacacggacgtggacgtttgcagtcacagcgttagctggtgctacagcagtatgggtatactttgtccatgtctcagaagtgagataggatgcgttggatggagttcctgaataggaaattgctgctccagtagaatcgttccaacgaatttgaacgaacactctgacgccagcagtgcctcgagcatagattgaggcaatagctggttcgccagcttggactttagcagctttgatctgcgagttggaaacagcttcaaaatatcctgtggtggccagattagcaatatccatacgatatgctttacttgcgcttgacagtgtgctatcaacaattgagcgagtgacggttgcactcccgatgccaccgttgctacttgtccagcctaccgttgtaccagtgaagaagttaccattggcaatctgattgtcgccaccaatgcttgtctgcaaggttgtaacatcacttgccgctgcagcgccaatttccgcaaggctccatgatacgttggcagagccgttcaccgacttacccgtcgacccaatcgtcagggtgcgagctgtgccccaaagagaagtcgtgatgtttgcagagccgttgaagctcgttccgttgattgtacgcgcagttgcaaggactgtcgcagatgcagcagtacctgtggtagacagagcaccaatgtctgaaaggacttgagcaggggtacgaagctcaaaggcagagttggacactgcacggagatagctgtttgcagtcagtgaggcgagacctgttccgccgtagtctactggaacagtatcacccgtttgtgcttgctgcacttcaccgcttgcattgattagaactggcttgatagatgccatgtgacattcctagtaatacagcgatatttattcaaaggaaaaggagcactaggctcctcttccgtgtcaacctgtttttgattgtgtatcagagaacgattactcgctcgatgcgaagagcaagcttggtcgtgctcacagcgataccaaccggagcaaggatgcctgtgaccggagcagtcgtggtcagtgcacctgaggttgtgttggagaggtagtactttgcacctgtggtcaaaccaccagactgaccggtgatcgcatcccactgagcagttgtcgcggtaacaacacctgccacagcaacgtttgccgccgccccagccgcagtagagactgaagtcacaatgcctacgacgttggaggtgttgtagttgttcgcgtttgcaaggtcacaggtattagcaccggagatgtagactgctcgtccaatgacgattgcgcctgcattgccgttggtcagcgagcttacaacctgatccgaagcagtagatgtacctgcagtgacacgtccatagacgtcaactgtcacgctgttatacgtgcctgccgcaacgcctgtggtagccaggtcgagtgttgggttacctgagacaccgttaccgttggtgatggtcagtcgagcagttgatgccacagcaatagaacgcccggcgaatgtgccagccgctgtctgtaccaggaagccgttggtgttgtaggctgccagtgcagtgaggtttgtcgaagctgcctgagcgccaatgtctgcaggtgttgcggttgcaccgacagtgacacgaccgtaggtatcaacggttaccttggtgtaggtacctgctgagacaccagaagttgccaggccaattccgctacctgtgacagtgatctgtcctgatacacccacagcagagaactgcgtgcctgtcaggctgagaccgttacctgcggtatactgagcagcgccaccgacctgtacgaatgagattgcatcggtgcctacgacaggtgcagtcgtgttaccaacgccccatgtggtgaagccatacagagtaccctgttgaacgaagatctgtcgagcaggagtgaattctgaggactggtcagcatctgttgctcgagtccaagcgcctgtggcaacgacatagacaccgttctgggaagcagttgtctgctgtgcaaccagaacacgatcacctgcaacgagtgcaactccgtcgattgtctgtgtaccactcagggtagtgttacccgtggtacgaacctttgcaggagagaatggagggataccgccagatgccatcacagtatcgacatactgcttggttacagcgtgcatcgcatccgtaggatcagcgtgcaggctcaggtaaccagtgagcgagccacctgtaactttcaagtaggtcgagtcaaccagcgctgtgatgtccgctgtagtgacattggatgagcctgtgactcgtccgtaggcgtcgattgttaccttcttgaaagaaccaacgccgctatcagtgatagtagccagatcgaggataggatttccagccacaccattcgcattggtaatggtcagtcgagcggtagaggcaactgctacggtacgcgcaagccaaccattcgcgccgtcctgaaccaggaagcctgagcctgcgagcgcagcaagtgtatcaagtttgtcgctgtgaccttgaacgtctgtaccaatggcaaggccaaggttggttcgagcgcctgcggcagtagtggaaccggtaccaccggcatcaatgccgacgctgtctccggtctggaagcgagtcagctcgttattagagcctagcttaaggggtttgaagtctgccatatccgtctcttatagtttgatcgacaagtcaaggtcaatcaggaagtctgtgttatttaaggcgtagccgacctttacaaggtactcagggaattccgtaggcggagtcatcgtaagctgagaatcaatgttcacgtaatagaacatcgtcgttgcaagaccgccgacctgattggttaccaagtcccagttctcaggagacagagtgaatagaccggactgctgaatctttagctgttcccctgggttcgacgcatcaacagcaagtccaaggcatgtctgtcttggaccagtggagcgagcacgcaggtatgagttgccaaccttgcagacaggagtgccaggcaggaaggtttcgccaccagtgttggttacaaagatgatctgtgagtttcctccgccaccaccgcccgaaccaatttggttgtagatgtcgttgatggtgtcctgcaggccaggaatgtgcgagacaggaacttcatcggctgtatcaactacaccattagcatccttgtcatagatcgcacggaacatatcgccagttccttcgataggaatgacgataggtggctcagatgggtttggttgcagtggcaggaagtccgttgaagacgcatcctcacggtacttgatgcaaacattgccagagtttggcttgccgattacgagacctttcaagacagcacaacctcgagtgattgtccagatgcaaagttcaacgccatactctgtccccacttcaagaggaagatgttagcattggcgctataggtgatctcaaagccttggtcttccaatacctggaaggtaggagcaaagaggttctgcacagcaggagcaggaacagatgggaagccgaaggacagttgcaggttgccaagagtagcagcagccttgatctccttgccgagcttagtctgcagggtgaagtcagattcgttgcgaaggtctgtaccattggtcatgcaaaggtagagcagacctgcacggaatgcaatgcccaggttcggaatcatttctggaatggcacgggtaacttccctagcttcgagccaggacatgtttgggtgatcccatgcaattttcagcttgcctgcctctccatcataggtacagatgaagccacgcatcgtgtagtgttcaaccagcttgtagacaagatcaggaacatggtagagctgctcaaatgtcggagcgtctgccaaatagctgaaattgaacgctaccgcagcctcacggatggcttgatccagagcagctgtctgtccatcgaagtcatcagttactacgggaagggaaattaggtcatccatctatcaattctcgatgaaccaagtcgtggcgtcaattaggaaaactcgcacgcttgtattcgcaggaatgctaaaggtagttgctgacccggtacctttgacgcggaaagtttcaccgctcttcggagtcagcgtaatggctgccgtatgaagattgtagatggtgaatgtgtcggtatcagcgattacagctgcatcggtggtgagggttgcagccgctttcacaaagacacggcgattggcatgtgtctttgcaagggtggtgtttgcggtcagtgagataggcgccaaaggatccggtgtcggctcaggcacttctaggagagtctttgcagcttcaactgtggcaatcttcatcaactgcttacccacagtggttgcatcgctgacgtcgtttgctacaagtccgctctttacgtaattcttcagtgtagagagaacagatgcacccgtaacgccatccttctggaccgcgacaatctcggtgccggtgaaagtagtgaccggggtgcgagcatagagttggtctaggttaatcaaggctcgatccttatcaatttgatatcctcgatatttatagacttccttcacgacctcctcatgttgcagttcaggaaagttttcctataaatatcgcgatacccctcagccctatagactaaccatggaccaagctgcatccgaaagcctattggcacagatccttattatcgtgcaagaagtccaggtctcgatcgagagttttgaaaagcgtctagatgaagcaaagactgcaatcgaagccatcaaccgacgcattgacacggtgattgaaacaggatttccaaaaggcgacctcgttagccacagacagtggcacgaagaaaaagaccttcctgcctggaagagaattgtcctcaacctgatcctaaagtaatggaaccaatcacccctgcaattattggcggatccatcgtagccgcgcttggcggcgcgggtattttcttgcgtcggcttgcccgagacaagttagagttggtccgtgaccgtgcagaaggaaacttgatcgaggacctgatcaagcaaagagacgatgcccgcaaggagaaagcggacatggaagtagagcttcttaagattggagaagaagctgatcaatgtttggaaaaggtgaaagagctgctgtccaaagaacagcaactccgaatccaaaatgcaatgttgacacagctgctcgagaagctcgcaaccgcgttggatacatctaaggcagaacttgctgccgcactaggaacagcgaatcagtcccaggtaggctgattcgttcctttaagcgcagaccctacttctgtcagggtctcaacaaacttatctttctgatgattacactctgaacatttcagacttctgtgaacatgatattcagtccattcaaagccccacgggtcaagaatgatgtacttcttgtaccaacggttggaccactgtccccatttgtgaatgcctagacggcagagtagtctcattagtagcctcgggtgctaacttggttgctacagcaagggcaaggaacgtaatagaccgtttccgtatcgccggtgtaatcgctaacctgcttcttctgtacgtcagcaagaacgaaacgaagaatcgaagcacaattcctacaggtcgcctcacgatactgcgcttggtctttgccgatcacttcaattgccatttcaaactccttgagttggctgaggtggattattcaatccagttccggaaaccttctacacctggtggtgtcagaggccgcggcgtttcagaagcgagatacagcgcgccgatcttagctcccggtgtgccatcaatgacagctgatgcaagatagaaatgagctgtctgctcaccgctcttcaatttctctacgtcacgaatttccattcttctgccttatggtaggaggataaggtcctgagtttccagctgggcataggcttcatcaaacgccttgagctcatggcgccagaacccagcgtcatcttgatcataatcccttggcggtgaattctcaatcgccagttcgattgccttgcgccacacatctttgtgggtgacgaaattgtgatggatcgctgtagtcatcgctttagtctcagattgtcgcgtcgccgcatcagaatgttgccgaggtagttgaggccttcgccgtcgcactgtccccagaatttgtcaccccaggtattgccttcgatgaggattgcatcgcccgtgtcaagcaacttctttgccaacggcgtgccttcctcgaacttagcgtcgatgactttgaccatcaccgacaccttgatgctgtcccagttcttccagatctctacatgcctgcccatgcgctttgcttgacctgcagtgagcataggattcaggaacagatcatactcttcctgtttagcacatttcgatgcttggtaggcatgttccgcagtcgcccaaacatgtccatcgtattccatcatctcacgatagaagttagagaggaattcgtggtcgccgcggaacgaatcgatcacttccctttgaaagatatctgccatggtttagtccagatgcattaagatacacgggcaccacaggatgcagaacccgacgattaggccaatcagtgctgcaggaaagaatcctgtgaaccaaatggtgccaatgatgccaccgaccacaaagccgatgacaccgaggatcagagaggcaacaaactcgttcattccttttcacccagcaggtattcagggctgatcgccttgaacgagaacacgtcgccacggtgctgaatgtctgacttgtagacgatgccttcgcgcagcgtgtcggcgagaatgctcttgcctgttgccttgctcaggaactccttgtacgattccttcgtagcgtattcgcctcgagtcatcgtgaacagagtatggacatagcccacattctttcccgcgaaaggcttgatgaactcttccaggaagacatgtcgacccagtggcgtcaggtaatggtcatgagcaaagacatcgtagatcatgaaacgatgtgccgtcagtccgtagatgttgccctgaacgccaggaccgatcagctcgccacgaatagcaatgcgaggaatgaagtcatcctgattgaagcgagcaatccacgcagtgagcgcatcaaagatgccacttgccttggcgacgtcgatgaaggtgttaccttcctgttccagcttgaggtccaggtttcgactggtcacaccaatcttctcaccatcatggtagatggtcatcgaggagccttcgaacttctcttcggcgtggtacttgccctcaggtgcacgaccgaagcagttctgaattcgatcctgatccgttttcggcagccacactggatagttgcctgcaatcattcctgcgagctgtgccgggatcggcttctcgtacttcttgacgccgaagacaaccgacaggtcatcgtcaagctcgaaagtctgataatccggagtgcagatgcgaagaccaatgctccagtctgacgggacaggaatcagcagaccctgagacacctgaccgcgcagcttgatagtgcgcagacgatgaccttcgagcagaccaccatcctcggtcggctgcatcttgcatccacgcgccatcaagaaggcgaaacgttcgtcaccgtaaggcaggatcgaatcgatctcgaaatagatggcctggtcgccttccttgaattcgcccttcttgaccacacagctccagccgtcgacgactgccacttcaatggcatccgcgccttcaatgggaacaatttctgcgacagtgcgcagggttacgagcttacgcatatttcttccttagacctcatagtcgaatttgccacagacttcgcactggtggtgccagtcgcctgggaacattggatcgggtcgatcagtcttgacccacttcttgtgctgacaatgatcagccattgccttagaaaaatcttcgaggacaacactcaacagcccacgatcagtttcgctcatagtcttatcccggacgcgttgatcagcccaatgcctgacaacctgcagaagcgcgatctgtgcttcgagacccttctcatatttgtttagagtctcgagatgcgatttcagtgcagtggtcagctcgcgctctttctttgccaggtcaatctcgagagaatgaatccgagaatccttacgacttccaaatggccacatgatcaacccttgagtttgattttgagaatcggttcaatgaactcttcgaagtagagtcctggcatgacgaaccatccaatagccgggatcagagttggccacaggatgtgaaagagatagctaatcaggtccttgacatagacagttttcgaccaacggtagtagttcaccagcttcttcaatgctggcgggaaggccagtacaagtggccccaagaatgtaactgccaaccacaataatgtctccataccgttatgatatttggagaccatagataggtcaagcgccagggtaaaacctggcgctctagaaagtttctagttgacgttcgatcagaacggtggtgtcaatctctcaccccacttaggcgtgcgccctgcttctacatctgcctgccacttctcggtcatggtcagacggtaggcttcgatcagctccatgtccttgtgcggtgtgcagttcgggaacggagtgcgggcatgttccttgatgcggctcggaaccttctcgagcacgtccttcagatctgcccaggtcttgtggactttgccgttgcggctttcaaattctgcagccagcgctacaaagtgacggtaggtccagttgtaattgccgaagctctcccggacccagatggcgcacggatgattctggtgcgtgggcttgtagaggaccttggcccggctcccctttttcagatgatgcgcggtacagagtaactgcgcagtttcgaccaccatcttgttcagacgcaggttgtccaagttccgtgcagctagaaccggactcaggtgcgtgacgaagatgttcatgacgatctccaggttacctcaatactgcagagggttaacgtactcgtgacggattttgaacgtcggatcattgaactcaggcaacttgcaaacctgagaccggaagtgcgccttgcaggacttgatgctccgttccgcagggtactcggctacgtagaggatgtgcgtgtaggtccgggcgccgcctgagcattcgatcggcttctgatactcagcaaagaagcgcggcacatagtggaccattcggacataggcgtcaggatcaccgccctgaatcacgtccatcatcttttctgcttcctcgacgttgtcgtgttcagactggtcctgccagccaccatcgaggacttggattacgatcttcattactcggcttccttacgaacacagatccacacgtcctcagtcttgcccgcaacccgggtagcaacattcactgtgacgtatgcgtaggctgcggggttgtcgctcctccgaacccggagggcttcctcaaccagcttttcgtcacctgcgacgagcatcggcagctgagcaaaatccagtgcctgttgcgggagtagactgattcggcgcattgttcgttctccgaaaggtggggcgacttgcgccgccccgtagggctcaggcttcggtggtttcggcgacgacggcttcggttgccttcggcttggtagccttggtcgtcttcttggtcgccggcttcgcggcttcgcctgccgggacgatggagttgaagaagcggaggatgcgctggatgtccgcgcccttcaggcagaggcggcgaccacggtacttgatgaactcgcgcagcttctcgccggcggcgttttcgctggagtaggtggtctcggtcttggcaccgacttcggagaaggtcaggtccgccttgagcttgccgccgtcgttggtgaaggcgatgctggtcttccacttacgaccgctgcggctggtgatgttgccggcttcgacgtgctgcaccccggaagtctccgctcccatcttgaagccagtgactgccttcacggcaccggcgacggcttcattctgggtcttggtcaacttgctcatcttcgtgtcctttgtgtttgttgaggagtgtttgtcccacaaccacatattaagttctttctgtcctgaggacaaccttacgaatcagacacttacaactctcaggacaaaaagtcacgaattctggagatttctggtcagttctcgaggggttctggccccgtttctggacctgcccgctttccgccagcgggacgtggtctgccagaagaccccgccctcgcggacaaaccatgcgaatggcttgtttcccttgtagaaggtgaagcggtgctcgcccttctccttggcgtgcgagtagtggacttcattcgagaagtcgatctcctcaacaggatagaattcctcacggcaatgatgcacgcggagatcatagtagacagactgccacagtggtccatgaccatcatgttcatccggcgtctgtcccgggaagactttcttagccttctttgcgaagcgctcaatctcacaaacggtgtgcgatagctcgtgagccatcgtccatgaaatgtgctgcttccagttcgctctacccggaccaatgcctggtttgtcgttgaggaactcatactcgttgaaatagaatttgccggtcttgccgacgtgctgccaaacctcatgaggcatcaacatgacgaacggttcgtcgttctcgagtgatccgccccagctatggactgcattccttttccaattgaagaaaagctgagggttgtagtccctcagcttatacttcttgatcagatagtcccgctgacgtacaagttcttgttcacagaacgctgtaaggatcttacgttgttctggatgcgcgggttgtgatgccattacctacaccgtgatcagccgtttctgcgatatttagacaggtcgactgtcaggtcttcgttgtcttccttatgaccaagtcgcattgccatgttcttttccgtctcacggacttgaacacaacgacaccacacgtctgcaggtgcgccgatctcgcgaaggaagccggtgttgatgtacttgtagaggaagtccgcaatcgcttcacagccagttgcttcgacttcggtgatcttcatcagacccaggtcacccagcttcttgatcgcatcatagtgcggctcatcttgtgccaggagatagcaatggtcgaagtattcttccaggaagtccttcagcggacgcagaccgccgtagtcaacaacccagttacgagaatccaaattgtccgactcgaactcgaaatagaacgacagcgcgtagccgtggatcagattacagttgccttggtcgcgccactggcgatatgcaaccggagccaactccttgtattcttttgttgaaacgaaacgcttactcattgaacatgcctcgatgtgaatctacattacttatgatacaggactggtcacttcgtcgccaaggaacattgatacaatttgcaggttgagacggaagttttcgatctcacgagcaactcgcatccaacgcttttccttcttgctccgaccatcttcgagccagagcgcttcatctgggtcaagaccgagaagttcgcacttgtatcgtgctgccttctcgatgcgtccttcggattggatgtctcttagtccgagcgacattctggcttcacctggctacgaacacggaacgactgagagtaggcagcagaggaacactctgagacaacctcattccaatcgttgtagacggtcttctgcggaccgggcggaatggtggccaaacactgctggaaaatctgattccgcaggcactggtcgatcgtggacttgctttcttgctgaactgtgtagtcttctcggctcatacagcctgccaacgaaagaaccagcatcagtgcgatcagaaacttcttcatggtgtgtcaccttttaggcgttgacgtttaccacgtattatataggctacctgacgaagatctacctcgacagcgccgtgctggaccgccaaggctctcttcgaaagagcaatgtcgtagtggctatggacggttccagctttctgatgccactttctttggacgccaatcttgtctgccatggcgtgtagctcttcgtcggtgtcagctagcatgtggcacatgatcatcctgccatagggcgctctcatgctatcgacatagacggtcatctttcatcctcgaaactatgctggtgatctttgatgttcaacatagccttctccatagcttcacgcgctgtcttgccgacgcttagagcgccataccctccaccggaacgcaggcgcatacataccatgaagctacggtcacgggtatcactaaagatcgcctcgttccgttccatccagtcgagcatctcagtgtctgtgaacttgtattcaacaacgtcggctcgcacaagacgaacctgagcggtgccatcaaggaaggtatccgggaaacttgctagtctccattcacttccgggcaaactagcaataagagaagccaaatcctcaggagtatggcacctgatctccttatgcgtttccactttcttcagggaaggcttcctcatagtcctttgctcgtttcgtatccagcgttgcaaccattgcagacatagtagttcggatcgcgtgtcttagagaagacgttcgctccacaatcatccgccgtgcaacggaaccaacgactctcgcctttgatagtcaggcatgtgtccgaacctacgataggtagatgccaatcatcaatcttttgctcagtgataggttcaggaggatcctgttccttcagatattgttcaagcattccgatccacgtatgaatcggaattgcctgatagcctgcaccaatggcgtcccaagcacgcgccttggctttcatgtcatcaattactgtctggattttcattgagaggctcgaacctgacttcgcagttcttagaaatctctttcataccggcttcaaaatcttcaatgctaagctcgtcgtatcccatccagttgccgtccttccaaaagttcacggcaacattgaagtggacatcaacgaactcgccatcaggaagatgatacctgcctcgaatgtctttcatcgctgagactccggatagttcttgaatgcccagttgagtagcttacgtacccacctaggcgccttaaaatcgtacagcctgttcgagacagtgcaaagccattgtccaattggccagaggacatagtgcaatggatagagaacgaatacgatcagcgctgctggcagaatcattggcatcactgtccaccatcgccaattcttgaatgtcctcttccaacgtagattatcttgcggaattgtcactgcgagttctccactacgaatggccacggtagtcccaacatacgttgtcttcgatcagttggcgatgctgaatccaaccctggaagttgccagaccaagccttgttgtaacggtcgatgtgagtgacgccttcatcccagttgtagacgggaccttcagtctcatcgtacagagttttcatcggggttgcctgatgttcaaacggcgatgcgtgaaccggctttgcctcaaccagacgtcggaagatgtcctgtgccttttccagcgagtcatccagcacacgatacgacacctgagcacagcaagaagcagagatcgccagtgcttccttcagcgtgttgccaccgcgcttgtcatcgacttcctcgagttccttgccgcgtgcatatccacttgcaaaccactgaccgttcttgtagtaaggaacgtgccagtctccaggacgcagcagtttcgggaaggatgcagcttttgcctcgagcatcttctcagcgagaatcttgatctcaggctgagcatcagcgtggtttcgcagccagaagaaattgtcgtactcggttgcagttacgacgaccttgatgtgcgagaatggttccagcaaacggttgatgatctgcttgtgatacttcgcagcggcaaaggcagtcgcagcttcgacagcgcgatcgcgcgcccaattccatgcgcccaggcgactgatcgaataacgagtgccgatggtcagctggataggctcatcctgctcttcctttgcagacatgcctggctgattcttgccccaatggctgggtgcagcggtgtcttccaggatcaggcgaatcgccttgtcgatcggaattgcacggctcgatgcagcattgcgcgagaacagacgatgggtcatgaactccgaatggatgaagcgtgggtattccaattcgtaggttgtgattcgcttaccgttagggtcaatcgaatcagcaatgatttttgcagaaatggtcaaagtgttctccggttaccaataaatcgtcagcttgaattccgcctctcgctccagaggagtgtccgtatcccatgtttggaaccccattgccggatgggcataaggccccgtagctttccaactgtaggtgaatccgagcttcttgagctcctcacagagcatcttgagcaaagtgctcatctcaggttctgtgctacctgcagtgtgagttttcgagtcatgtgggatcgtgatgcctttgttgccctttgccgcttccgctcgaataagcggatccaaagttgccatcaggtcagcaacgttcttgatttctcgggcttgggcagcagttagcatccgtcatcggtctcttgagggaatggaatgattagcgaacctgacagtccgccaggcgaatcaaaataatacaggctttcggtcatcggctcaaggtcatccaggtacacttcaagaacctcaccggactcgcgctcaatgactacgattctccttccttcgcacagctgccgactcttcagtcgaacagaaacagtctcagtttcgccattgatgttgagcatcgttggcatgaaggaacaacgatagtcgaggtgctggtcagcccagtgaataaggttcatttcagattctcaggaagcggttcttgaattggctcaggaacgacggaatagcaacattctcgccgatcatgatacgataagactggctcgattgatagatgccatatccttctcgtacataccgttctgccacatcacccgctcgcagttcgcctcgaacacgacccttgaatcgctcatacagataggacagccatgcttcgtggcatgcccagatatcaaagatgaagacgtcagccttgaagtcgtagatgaagtccagctcgaggatgcgaatcagttccgaagccaggtcatggttgtcggtgacgaacgcgtactcgctgccatccaggaagtcaataccaaactcatcaacaaagtcgttggcgtaggcttcgttgaggcgatcaatggcaaactgcataccacgattgtgttcaaccacatggaaatattcagtgatacgacgaccatacagcgggtcgttgttcttcttcatttcccagagcttgtcttcctcttcatccgtcagcaggacgtcgagcttatatcggttgatcatgcgtttgctgcctcacgcagaagaacagggacatacccatcgtctcggacaaagctcttgtctaccttgaaaggccatgctgctggcttgcctgtcagataagcagccatcggacgagcgatctcggagggctgctcaaagaggtagcccattccgttctcgatgaagtatgtcaccatgaatgcgttcattggatttccggataccgatttgcgatggattccgccagacgaccttcggtgcgaccacatttgaaaatcatccagtcagaaaccatttcatggaacggcttggatgcttcggcgtggccttccttattgaagtggaatgccatctcttcgatcatcaacatcacatcagccatttcttcagccatgtgattgaagttttcgaaggtggccttccgcttggtgtacttctgcaccgcgacgatcagctcgcccaattcctcgacgagcatatcggtctgggcaggcacaccccagtggtcgagacagtcagcgtagagatcttcgcgattgactcggctgagccagactgcgccggtcaccgcagcggatccggcttggtggcgttttccaggttctggaatacttcgcgtagcgcctcgacggtgtaaggttccttacgatcgttcagggagccacccagggtgacgacgtctgctgccaacttgaccggcgaaactgcaacgccgacggctgccttaagaagagatccaaacatgttcttttcctcagtgataggtgatgatctgatcgatctcgagctccagggcctcagcctcgaagtaggaaatctcacggttgagttctgccagagcagccttgttgatcgcctgatcttcagcgatctccttgatgcgatgacggttgtgagcacgagcatggttcagctcacggatggtacgaaccagctcgtcatagatgacgtcgccatgattcagaccacgggcacgcgcgtcttccagtgccagtccgacacgcttgatttctgccttcaaggtcggcagcatcacttcgacctcgtgacgtgcttcatcgcgcaggtcttcgatcgaattgtagacgtgacggcgagtctcgatcagatgggcgtgatgcagggcgtccagcatttcagtggctttctgtgcggcgatggtcatgatcaaataccttttcaaagtgtgtcaaagcattatacagcggtgtaaggctttctcagcctacgaatttttgctcgattgctgccttgcggaaggcaaccaacttggcctcgtcggtttcgttgtggcagcccattcgcttgcaaccgtcgacgaaacctacgcctgagcaaccatcgaaaccttccggttccgtgttaccaagagcgtcgatcgcttcttgatagaaagtcgtgtccattatttcctcattactgattctagttcgaaagcagatttcaggccagaaatagcatcgttcgcctgcatcaccgcccgtacaccaaatggtgtcgccgacacgtgctgagcctgccatgctaacagccaggcgtattctcgcacggtcagctcggtcatcggcttgtcaagatcaattagcattgaacattgcctccatctgtgcctggatgtgaccctcacggtaagcgcaattcagcagctcaaccacttgtcgtgctagactttcgtccttcacttcgcggatcacagtttcatcgtagacgatgtcgtaggtgtcccagaagaaaccaacctttcgggctcggtagctgtagggcttgcgcttagtgatatcgaatctcattcttcgtagtccagtaggtcaggcttctctccaatgcccagagaatagttgacttcggcggcggtgaactctgctcggctacgactcttgaacatgaagagagattcgttccgctccggtgtgcccaacatgacgtagtattccatgccggcggaagtcttcatgtctgcaacgaaagcctgaggctgctttacagccttcgcatccttgatcgcattgatcaagaacatcagaccttgtttgcccatgaaccactcgctgggattgccatcgctatcatccggaagaagttccagaggatattcgccacgctctgccagactcagaaagacattgtaggcatgggtggcggcttcgatcagcttttcgagtgcggcggcctggctcatttcactgtaccttgatgcaagagagggattggtcaccgtacagatagtggtaacaaaccacgccgtacttgtctggtttcgagaaggcttctactcgatgctcgaacgatttgttcgtccagggcgaggtgacggtctcacctgccgcagcagttgctgcctctggcggactcggaagttcctggcgcgaacatgcggtgaggctcagagccagaagagcgattgagagaatctttttcattgcttgtcccagatggtggtgtcgaaaactcggcgctctacttccaggaatgcctcgaccatccattcaggccagatcggtgtgctggtaccgaacagatcacgggtttcctttgcggtcatgtagccgaagtgctcatagaactttcgagccgcagccatataaccatcgcggtgcaccatgccttcagtatatgcggcttggtcagaacgacacaccatcaccgcaaagaccatgacgccctggaagaaaatctgcttcttgttctcgatcatttctctgcgttccggagttcaattgccttgagggtgttcgcttccaccaggtccatcgagatgtccacgacttcgagaacgagttggtattgctcttcggtcagttcgcgttgcaggctgatatcaattgcagctgctcttgcgatcttctggatgatttcgtctttggtcataccggcaccgtctccatccgcttcttacgacgaaccttcggcttcttgctcaggaacgtcttgggtttcttcttccccttccatgcccaggggtagttgtttgccttcggggtcaatccacgcgctgccagcttggcacagtagtcgccgtagcgttcttcgtctgacggtacaggcggaacctggatggagagattgccttccatacggcgacgggtgtcaatgatgattccttcgcgcatcaacatctgcataaacttgtctcagtcctcgagatagggtttccactcttccgggaagctcatgttgctatatggagcgttccggaacagaggagcgatctgctcgtcggtgtagcctgcgaggccacaaccgattcgagtaacgaaataccgacgggtgttgaagaggtgaccagcctgacgaatgaattcgtcgatgtgaggcttgatcagttcgagcggcagggtctggatgcgttcatccttggtcggaattgcgtaagaccgaccctgcccaccaataccaacgccatacacggcaccatagtgctcgagtgcggctcttgctgcgcctgcaccatgccgaccggcgaggttactgccgaagacgaaaatctcgtccggtgctgcctgggtgccgtctttatggtaggtgcgcatcactgttccttggatgaggtgttcacgacggggcgtgtgcagctcttgccgcaattctcttcgtaggccaccgatgccgaatgcgaacagtctgcatagtagacgtagcgaatgttgccgtcgaggaatcggtagaccgtgcagccatccttgacgaaaagcttctcgacctggatgccgttctgggtatagctggcttcttgtggcggcgaatgctcgaagcatccggtcaacccgccggcaatggccagggccaatccgaggacgccgtagaggctgccgttcttgatacgcatgctcattcgtcaccttccttgaccttcttggccttcggagcgcgcttgagcgaatccttccagaagacgtgctgcacgccgttcacgttgccgtagaacttcttcagttcgtaggggaacttcgagacgttggtcaccttggttccgacttcgatgtagaccgtctggaatccatcgacacgattgccaacatacgccggcaccttcgaaagacccttgacctgcggaacgacaacatactcagacatttcggaacctcttggagtgatttgtttttcggaactgtttaccactcacacagtctacagatcaggcacttctggaacaaccttttcgtaggccagaaagttctcgattgacgcaagaaaagccacatttctgtggcttctcctacttgcagaaagttttcttactgcacgagcaccgaagtgccaggcggcgctacgatacagctcttgcttgccttacaggcatcggcttggatgttggcaatctggagacgaagatactgctcaggagacagaagcatttcgtttcggtatgcgttgtcagcagctgccttcgaaatctgttgctgctttcgagcctgttcagccaagtcggcttgaaccatcgtcttggcgcgctgctgctcggctgctgtcaggttcatctgctggagaacatcgggattaggcttagctcgtcccagggagacatccatcaccacaacattgtcacctagcttttccttgaccagtgcaatcagcttctcggtcacgtcggcatctacttcctgagctgtcttttggccagacatcagttcattcatgtccttggtcttgacagcatcgcgaacaatggctcggtagttagcctggatgttgttcttgaaccaatcaggtcccttggtcttgtagagctgagatgcgttcttgacctgtagctggatgttcgtctcgaagtccagaaggatgttgtctttgctagacaggtcgtcgaagttcacaggaatgttctgcggagtgacgtccacatagatcgcctccgtcgtaagtgccacgaactcgcgcccaggcttgacggtttcatccagcacgccaccggtgccgaagatcatcggcttggcgaccagaacagcttcctgaccaggatcaggcgaaaccacagaacaaccggtggtagctagaacagcagccatcagaattgctacaaagaacttcttcatggattaattctttcctttgactttacgatagatataggcaacaagaacgacagcaagagtcaggccaatgatagaaccccagatgccagcaacaagtgcaaccggaatccacagaggcgacgttacccaccaccaagaccaacctgcgacgacaccaaccttacccagcttaagaccgatgaacaacagtgctagcagaggcaggaaaggaacgccgaaccttatcgagatatttttaacttcactcacatacttctccttaggctgcaaccttcaacagattgcgatacatgtcttgcttcttcgagtcaccatgcccgacataagcatcccagaattgacgagacggatcgcgcttgcctgtaccatgtgtgaagtgctccgtaatcgcacacagcgtaccgtacgccgtgcccttggagtaaccggacccactaccacccagagccagatcggtcaaacgcgtaacttctcggttcacaccccaggtttgttcgtctgcacgacgttctggattgtacagctgctcttcgaagaactctcgagtctgacgagcagacatcttcttgttcgccagtttccgcatgttggccatgaaatctgcccaacccttgtcgatcagcttgagatcgatcttcacctgggtcggatcgaagtccttcttatgcgtcactcgaatcactggacgagagcttgctccctgcagagcaatcgtcagagtgttgttgcaaaccactcgggtcgaggtgaaacgcgcttgggtcgacatcgttccatccacagccgttgtcagcagcagatgtccgtcaatctgatccttgtcgataacgttctcgctcttgccaacatctgcaagtgcccagaaacgacgaccaccaaagagcgatccagctgtactaagtttgaaaccatgcagttcaacaaggtctcggaagaactcgatgacctgatcaggctgtacgatcttgaaatcattcgagacaatgcccagggcttccttgttgtccgaacggaacagaacgcgcttgtccggaatcgaatgcttctcaggcttaccctttgcacttactgcggtgtaatcgacagtggattcgtgtacttcccaatccagacctgccatgcgcttccaatcatcgaaggaagcattttcatcgacctgctgaccaagtccgtgccaaactgcgctgcgaggaccggtaaacgccatttcacttgtgccgtctgcacgttcagtaatttcgtgtgccatctaaatcacgtactccaataataaagtgttaccgctaccacactcacagtctacatctttgacctggataggtcaatcaacagcttgaactgtcccaagaatgatcttcgcgagcgtcgtcatagccttcctgccaagcctgttgccttactgcttcgacgtcaacggtcgtagttgctgtttcccagagatcattcagcacaccgtaaaggtgagtgtcctgttcttcagggaatggaatgttcagcgctgagtaaacggttttgattgcgtttaccttaaggtagacgtctgaaaggcggtcgttttcaatgtccgaagtcaaattctattcctccatcaagtcggtaggtccactcgccacagccaccagaagtggtgtagggaacccatccatagggtttcagcttaaggtaaagccaggtattgaactctcggcggacgcgttcgtgttcattaggccaggtgtgcaagtctacggtgaggtagtacccactcgaccgcttcttgaacttgaacgatgccggcttcctttccatcaaaggatggttagtcgtaatgaacggagctgccttgagctccgccattaccgccttatagatttcagcgtttgtcatcttagaactcgatgtagggattgccaacctgcacgacgttcagacccaggtcacgccacatacggcacacgctaggacggtcatccagaacgatctgcacgtcgtagttgcccaggatgaactcgcggaagatctcttccttcacgatcgtgtccttacgctgatccgaagccttgcgcatcagcagccgacaaccgcccagccagtaaccatccggaccgaagacgttctgcagccacttctcggtcaggtcatagcattcatcactgcgaccagaagtgaacaggatgaagtgcccagctgccatcagccccttgaccatatcgatgatcggggtatgcggagcgtccaggtgcaccttgtgccactcgaacggaccacgaacaccttccatcagagctacggtaccatcaatgtcgacgatggcagccttgataccgtcttccggctgcttgatgcgaccaacgtgctgatcgatgaactgctggtgctgcttctgcagaacagaatagccgacaccatgagcacgctcgttatcgcgacgaacagcttcatcccaggtcacatcgaagaacttgtattcgacggtgtaacccaggccttccagcttggcagccatcgcgccacgaacgttctcgttcaagttcgtatcggcgatgatgacgtccttgccctgagccgcgcagagagccaggtcggcgtccacgcgttcagtgacgagattttcccacttccacttccagttggtccaggaaggcgagatgcccttctcttccatgatggaccaacggtagttgtcgcggctgatcacttcacccggctggtgcagagcccaggtagtcttacccgaggcagacacaccgatggtcagagttgccttcattacttgatgctccaatcgaccttgccggtctccagcagattgcggatgacgcgagcggtcttgtaggggtcgttgaaatccgaccagttgcttccgtcggcgtagatgccactcgcaccaaccggaatgaaaaggtcgactgcggtcttatgatccagttccagcaggtcctgcgcttcatagaagacagaatcccactcggcttcattggtagcatcatcttcctgccaagaggcaaagttgaaagctgcgttggccagctcaccgtcttcgtcgttgaagaactgcgttgctgcaccggcgatgcagcaggtggttccacaggaaggtgcatcgctcttgagcgcctggacaccgacggaaatgtcgaagcccttcaccttacccttgtgcggcgcgccggcttccagccactcggcgatgtagatcagacgttcacggttcatgatatattttccagagttgagttagtacttcacacaggagagattctgaggctcattgtagggctgaatccagtaacacttgattctcttctcgaggtcatcaagcatgtagactcgctcaccatttgctctcacgtcggtttgcacatattttacagcaggtgcatttcttgtgaccggcggtttcggtcggctcggttcatttgctgccgccatcatcgactgggtcagcatctgagtgttcgtgtccatgatgatgttctgcgccattgcagacagcggcatcatcagagcgaatgcgagaagaatcttcttcatagcggcaggcagctaattgccggaccgccaccatggtagacatacatcttctggatgtagcataccttgcgcagttcgtagtcaacgaaacggatcaccgaagtctcgcccttggtcgacggatcagggatctgcgtgaacctgaactgattcacattggcctgaacatacgacggaaccggcttcggctggggcagctgttctgcgttggcgcccaggggtagcgagattgctaccccgaaggctactgccagcgtccagaaagcaatgcgcttcttggagatggccatctcttacttcgccttcaccggcaggtcggtctcgacgccctcgttctcagcagccaggtcagccttgctgtagaacttgaccggctcgctcagatagagcgacttgatggcgagcttcgcttctgccgtcggagcagtagccaggtagcgcttgaactgcttggtggagatgcgtgcaccaacgtaggtcttggtgtccttcttttctttcacagccattgcggtattacctcttgttggattctttcgagacaaagattaccttgtcccagatggggtggttgtagatgaaatcgacgatgcgctttgccttgggaccgaaggtgacctcaacccactcggcaaagataaagaatcctgccagcaagttaaacaccgggatgattgccaacaagcacatcaatccgaagaagcccaggtcgcctaccgtgacctcatgggttttcacgtggtagatagcttcctgagtcaggtaggcgaggcagaagatgcttccgaatgcccagagtgcgaacaggatgatttcgatcatgacttgaatccgcagacaggctttctgaagaagtccctgatctggcgatcatattcaacgatatgatagatcgcgatgatgatcagaatccaccagttgatacctgggattgctgcgccgagaaggattgcaggaatcctgagcactgttccgatggtcagacagtcgtagtactggatgtcttcgaccgccttcttccaggtatagtacccgcctacgatgaggaggatgagcgcaggaagcgcccacccaaagataagcccaatcatgctgccatccgcatcgcgaccggcgtaccgcccggattgtcatcgtcgccttcggggcgattgtcgtggttcacgaactcaggctgcggaccgacttcgatttcgatctgttcgccctgcgggaagtcgaaacgaatgaagcgagtcttttcgttccgcttgcccaggtcatacaccgagacgccttcggcgccaacggcagaggaaatcgcccgcagatgttcgtcaacgacgaacttgtgagcttcactacctgcaacacgagcgacggcagcggagatcaatgcaaccttcgcgccgtccaacctgatcatcatcacaaagtcctgtttggttaccgtacaattatgatattgtttcgatgtagaaagaacaagttcttacttgatttccttcagctctcgaacgtacatgtccttcgccgtatctttttcgagggcaaccagggtagatttttcgttgtccgttgccttcgaaagttcttcgatcttatctttcgtcaagttccagataggcatctgcaacagtcgatcgtagtcttcgaacttgtttttctgcaacagttctaccaaggcatccttcttcaagttcttgaaggtagccgagttgtccagatagaaaagaatgaagcgcatccgctcactcagccaacgaatcttctcagccgttgcctcgatcagtttctggcgacgcttctcatagaagcccagacgagcctcgacgaaatactcgatcagctgttccggagtgtcgaaggtcttgatcttacccttgtgatcccagacaacgatgttctcagactcacgagagatcagtcccagcttgaccatcaggtcttcgtcagtctgagacttcaaccattcgcgcgtcgtgtagagagtgatcttccaaccagcctcttccgtcgagtcatcgtcgtagtccttgatccagcccttatcaatgagcttcgacaggtgcgactgatacttctcctgttcgataccaaccggcagttcagtgatcagaatagtcgtggtgttgacacgctcaaacttgccacggaacgtcgtctgcccatcgaccttcgagatatcgcccgtccaacccttgtaccaaggaaccagcttggtctgcttcttacctgcgagaacctgctgcacattgcgaacaacgtcatcaggattgtagttcagaatcgtacaagagtaaccagtaccgatgccctcactaccgttgaacagaattgtcggaaccttcggaatgaagaacgttggctcaatctgttcaccatcctcaaactcgtattcgaggatcaggtcgtcgtccttactgaaccacttgcggaagttgggcgaaccctcaaccgagatatatcgtccagacgaagccttgtgatcaaggatgttaccgaacgtgccatctggaatgaaccaattgacattgttcgaggttgggaagttctgcgccataccaacgatgacgccttccagattgcctgcaccatggtggtatgcagtttccgatgccacctgagccgaatatcgctcaacggtgttgagcttgttcgttcggttgatgacataggcggccttgcgctgactgatcttgaaaccatcaatcatgttcggaatgttgatcgcacaatcgtattccgagaatgatttgaagtctcgatcgaggaagtccttcactcgcagcttagtgatccccgacaaatcagtcggggtcgtttcaaaattgctatcgtcgtcgaaaaatctcattccagatccagccattccttacgtttgtcggtgaaaccagcttccttcaagaagcagaggtccatcgtttcctttgcagcgtcatcgaacgtgaactgtaccagataacggtccagattgtccatgtacttcttccactgcttcggagacgacgagccaagtcccttcaagaacttgtagctgtatttctcgttctgatgctttagacgccatgcctcaaactcttccatcgtgaagaattcgagatcctgcttcttgtagtcaacagtgaccacaggagtgacgagacgatagatctttcccttcttgacaaggtctggccacagtcggtagtacatgttcactaccagaccagcaatggagtgaccgaactggtcagcgtccgatgccacaatgatacgtccgaagtttagattgttcaagtccggagcttcgccgtacttcaaaccaacgacaattcgtgcattctcgaactgatcgttctcttttaccttcgccagaggtgcagccgacacattgatcgggcgaccgcgcagagcaaagatgccatgcagcttcggattacgagcacctcgcagaggacctgctgccgagtcaccctcagccaggaacagcgaggtcagatgacgatccttcttttcggttgcatcgttgaacttcggaatgtgcttcaggttcgccttatccgttgccttgttgagcttacggagctcacgcatttcttcctgatgagcctttgcagctgcccaatcaagtaccgactgaatgatcgtcgacttgatgatcttgtttacgaacttctgatcaatggtccagctcgtcttgaagtccttcacctcagtgatcaggtcttccttcgtctgagacgaatagcgaggattgacgatctgagcatcaatgaacagtcggaagtgctgcttcaactccgaaggcttgacgtcgatcttgtgcttcttcttgatgtgagcacggagctcagcacaaatctgattggccacatagtcgatatggctaccaccagtctttgtgcgagtaccattgacgaatgagatatgagcgaacccatcctcagcaccagcgataccaatcttccagtgctggttttcatcgtaggcatactcaggagtgaacatctcaatgtagtccttgaaggacttcaaattgatgcgactaccattgagatagaccttgaggtgagaattcgtagctgcaatctcatagacacgattgacgagaactgcaatgttcccttcatcaatgcccttcatgcccagcttttcaaagtcaggctgataggtgatctttgtgaagccacctgcacctggtcgaaccacaggtgtcgagcgagtctgcgagttgtccgagaactccatcttgaacttgtacttgccgtcacaagtttcaacaatgaacttcttgctgaagatattcgttagtgctgcaccttcaccgttctgaccagtgagcatcgactcgtcagcatcattgaagttgctacccgaacgaagctcgaagatcatctcaggaacgtactgattgtattccttgtgcttgatgacaggaataccaccattgtcgtagatagagatctcaccagtggagtgatcgatatcaaccttgatggtatcgagattcttgccttccggacgcttcgagtgatcgacagagttagagacaacttcatcgaacagcttgaggaagccaggattgaaagtcagctcacgctgctccatctttcccgaagtcgggcaatgttccacagaagtgtgggacgtaatgctcccgatgtaccgaccaggacgaagcagaacgtgttccacttctgacagttttctaaactgcttttcgattgttttcatgccttctactttttctttctttttgaagtttcttttaatgaatcttgctaccgaagcattatacaggaatcagaaagtcggtgtccacagttgcttagactatgatctaactttcgatagatcaatatccaatgggacggtaacgacgccctcaggcatatttcttgccatgtaggtgagggcgccaggaccgatgaactcaactaaccgattgaaccaagctttgtctagtacgacatgctcagatcgttgatcggtagtcatgcttcatgctcggcttggtttctaccggatccaatgccatgatgtagtagtcagggactacagatttattgttgtacttaagattgtaggctgtctggaagaccttggcttcctcgaaggtcgggaaaggaccagcatagccatcaatcttggaaccccaaccacgctcactttcatacataggaatcgagtaggacatttgattctcctttagcagccgaagttggaaggcagccagaagtgatagttgtcttcctggctgtacgggtaatggtcgagctgtgcgagttggacgatttcatccacatcgctttcaatgccctggcttccgtaggtgtagcaacggagatgcttctcagcatattccatcaggtccttacccagctcacggcgaaggtcaagagtctttttctggatttcttcagcgcgcttgcgcatacttcccagaactgctctgtccttctcgatcttttcaggagtcggtgcaccgaaaacgtcgaagggagtttcaacttcccaatcgcccttctcgaggcgctccagactctttcgcagctcacgagctacagcttcggcactgccagggttgtcgcccagagtaagaccacccagggtcattcccatcttttcaagctgagctttcagcttttcttgttcggtcggcttgttttcgttttcagtgctcatgatgtgtccttgttgggcggtttgccatgtgttcaactacttcttcccacgaccatggtaacaggttgtggccatcgactccaacgtcgagaatcttgccaggaatgccagtcggcttgccatggacgtgtccgtggatatgccaccaccctcgatggatctgcatccattcccagattgggaagtgacacagaacgatttgctggccctcacagctgatctcagcatacgaatagggatagatctgtgtccactgagaacggaacttctcgtccttgatgtgcttcttgtcgtggttgcctggaatcaagaacttctggccattgaggcgacgaagaaccttggtggacttttcaatgtcccatccgccgaagtcaccaacgtggtacacgcgatcctttctaccgatgcgagcgttccactcggtgatcatgtgttcatcgagctcatccacgtctgcgaaacgattacgcccattggggtaatgcttcatcagatttccatgggtaaagtgcgtgtcagaaataaagaatgtgttcatgactatatgatataacatcaatgacgaaacaacaccaaagaaaaacccgtagaagctttcgccgctacgggttctttctattaggctactacgatgccgtttgcggtcagcgttgcgtcggcaggagtgccaccttcgaacgaaacaacagcggtcatgctataggtacccggtgcaccaaagacgtgctgatagacaggaccgccttcaactgctgcaccagcctggagagctgccgtagcagtcgcgccagttccgtcaccggagatggtcacagttggagcagacagatatcctgcacctgggttggtgattgtgatgcctgttactgcaccgcctagagtagcagttgctactgctccggaaccgtcacctgtgaaagtgatcgcaggtgcagtgacataggcagtacctgggttagtcacaacgacagcggtgatcttaccacccatgaccgacgtcgcggtagcgccagtaccgtcaccactgatggtagcggtcgcgactccggtatagccagagccaggattcgtgatggtcacgccagttacagcgccacccgaaacggtgaccgtacctgttgcctgagtaccaccgcccggaggagcggagaatgcaacggttgcagcagtgtagccagttccgccagcgccaatggtcacgctcttgacagagtccttgacaatggttgcggtaccggtagcacgagtgcctgggccagttgcgaagctgacggttgcagtggtgtagagagaaccaccgttggaaacagcaacgctcttgacacgatcacgagtgaccgtcgcggttgcagttgcctgggtgccgcctgcaggaggagcagagattgctacggttgctgcggtatagttagtaccacctgcgccgatggtgatgcttgccagaggagatgcgcttccgccagtctgccagcttacagactcaatcttgtcgaggctgtggatagcgaactgaacacgcttgccgtgagcaacgtaattgatcaggttgcgagttgcaccgtccggatcaaggaacgactttgccttggcgtttggcttgtaaaaatcaacgggagtttcgccatcaagctgagatgctggaattgcacccgccgtcagctgttcgccggtcaacggatgtgcccagccgatcgcggttggaatggcttcagggagaaaacttagtggcattggtaaatgtcctgtgtgatgtatccacagtatttaccctttacgcacgcagtcttcccagattccaatggcacaatcaatgagaagctctatgacgcatccaacgccatagagcatatcataggcaaactctttgagagcctcagtcaatctctgcattttcgattgcacgattgatggccttcttggctgccttggcatcctcaggatcttcggcatctacggcgttgtaatagacgtagccgagctcttcatccatagccaccgagaactgattggcaacatccagagcattctttgccttgatcaggaacacatagtcgtcacctgattcggtctttgcagccacggcatagtatttcagcttatctttcgacttctctttcatatcaatctccaaaccattcatcaacggtgtagacgtagatctcgtcccagtggccatcatatgtcatatcgccaaggaagaattctctgcccttgtcatcaactaaggttacagcgtcgagcttatcgagtgcctcaaaaaattcgtcgtaactgatttcgttagctgcgtacttcgaacgaacctcgcgagtagccctttggttctggacatactctagcttcttctcctcgagcttttctttgaatgcttccttggaagcaaattccgcaggttcgatgaaggtgcgagtgtcatcatactcgccattggtccaatcaagaattagtcgcattcttctctgccttgtaacgttcaaaagcctccatgatcccttcctcaatctcagatgggaacatgctatacactttgtcctcaggcagcatccgcttcacaatctgcattagctcgcctagctcctttccatcaagacctgtcaactcgcgaacgatgttaccgttgagcttagccttgacttccttgcgaacagcattctggcaattcaggaacaggatctcacttcttaggtgaggccatttgtctttgtggcgctcaaggtgctttgccttatccgaaggaacatactcgccatcgaaggccaggcgctcaaggaacatgttgtacaccttgcgctttgcatcacggacacgcgcctgatgattacgatgctcaagtgggaaagcactcggctcgaaatatttgcaacgctcgacccaatcaaacatctgttcgaaggagtcaaagcctgcgcggtaatcgttgacgtcaaaaccaagatgacacagtgcagtgtcgtagtccttggtcagcggaatctcgcccagctggtggtcaccatcgcgatgcacataccacagaccatcatggccatgtttcagaccttgacggtgtgcgatgcgcccgatcagattgcccaggtcgttccaagagaagtactggaacgcaaattccatgtcttcatccttggtcttgttcaagtcaacctggatgtactttccgtcagtttcgatcaacagattgtagccgcaaccattggagatttcacctaccacccggaagccgttcttcatctgtttgagcgcagcttgaatctgcgagctcgccacaagaacatcgacgtcgccgtagctttccttgttcctcacagaatgaggaatggagaagcctgtgccgtagcccatgatgttctgcaggagccacttgatatcgtccacgacatctttgtagaactgcggtgtcaggcgttcagccttatcaaaagcgttgccgcccataattactccttctcgtagccttcctcttcggcaggcttctccttgagaccgtcaacagaccatccggtccagccgacctgcttcatcttccatcggtagttatccgatcctgcccacacgcagaggtgagcgaactgctcgacaatgctcatcaaattctctccagcttcatgattgcttcttccaattcatccgcgaacttgttcgcacccttttcatttccgcgccacgaatactcgcgacccagatcgccatgctcgagtcgatgcacgatagcttcgagcgtggtttcctcaggttcgaactgtccttcgagtccatagcaggaacagtggctaccgttcacttcgtagtacttgccccacttacggaacagaacgaaagcatcgccttcatatccggaggtttcgtagtatgcaaggatgatttgagcgtcatcgagatagttttcgatgcgctctgcgcctacacggttgtcgccattgccgaaatcgtaatggcagaaatcctggatcatctcctcacggttagaccaggagcccataaaaatgttcatagcaagatatcccttggttgatatggcggaagatgcgcaggtcgctcagctgggtagccacgcggattacagatcacttccgtctgaccgatagtatagttgatgtaatcgtgcgtatgtccgtgaacccaatagctgaggtcagggaaagactcgatcagcgcatcaaagtgattgcaatacgctttgttcaactcgtaatcagcacgaaaacggtttggcacagattgcatcgaaggagcatggtgggtcatcaccagcttgattccgttgctaggcttctcgaggaagtccatcaacctgttcttgcccttcatatgctcgatcaggatatcgcgcggagtgatctttcggtacccagccttcttgatgcgaatgttcctaaaatcattcaggccaaggaaggcagccatctcagcgatagggctaccgtgataatctgtccacagcgtgccaccaaagacatcaaggtgaccaaacgacctcacctcattacggagcggaatgatattcttccactgctccagatagacgtccatgtgatcgtcagcaacatctagctcagagcggtaaaactcgtggttgccggagatgacgaatacttgttccgccatcttggagacgccgtcgaagaactcagcaccgtgcttccgcagatagtcttcctcgccgaggtcaccagccaggagcagcaggtcgccacgccactggaagaactcggggttcatatctgcaaaatctagatggagatcagacgcgactccgactttcatacggcacctcatatttctgttgtacgattttccgaagcttttccttggtcagtatcgatttcttgccggcgcgagaaacagaatacgacgcaggaatttgaagatgcagcttcggaacgtagcgtgcaccatggtacttcatcggcttgagcgttccggtgaccttgagcgagtacagctgctcttcacccggatgccagaagtagccatcgtaattcggaaccgctaccagttccgtcggaattgtgttcatgctcacaggtcagacctcagccaatgtcccaacttagaattgtagattgtctcatatgtccagacaagaacgagaaccacagacactaccgtgttcccgataggtgcgagcgagatacctgcacccgtaaaccatgtccagacataattccacttggtagctttactccagacaccgcaccagtctctgtagcgcttcgtttccttgagggtctttatctcttccctccagatgtatcgtgcaggcagaggaatcgagatgaggtagacagcaaggaagatgaaaaattcgatcacagctttttcctcagccaatcaccgcacgcccagtcaatggtcgcaataagcgcaaagataagcccggtgcctgtgaatgccatattgatgacagggatgaaagtaacagccagagcgattgcaccacgacgaacaagagttccacgggttgctggcctctcaacactgtaaacgaaatccatgaacttcttgttcttccagatttcacgaagaccaatggcacagacgattccgttaactgcaacagctacccagtaaaggatcaggaaaactgtcgcttcggtcatgcgaacggcacctgatactccgtcggatacagcgactggagctccttcttggccatgaacttcttcttgccaccgacggagacagcccagccatcttcaccgtacgacttcttcgcctggtagcagccgacctgcttgatcggcttcaacttgccagacttgaacgagaacagctggcgcgaattgcgatcgtacaggtagccatcgtggacggtctgtaccaggtgcgccgggaacttcacgcaaacttcgttgctcattatcaattttccttcaaaggtgtataagtgctacacaattatgatatgcaggatgcctggatagaacaagatcagtaagtgaacagccttgccgaagaaaaattcttgatcacgttccagatgaactcatactcaaacgaatcttcatcatagtctcggaggtagtcatacttgcagaaaagaccatctgcaagatcttcgcgccaacttgcgatagtgatgtcgaaggctttcttaccaaaagcccagccgttcttcgacatgtcgtggttgagcccgaaagtttctttctcgaaagcttcgagcaaagccttctcagaaaagtccagcgtgcaatcttctggatgatagaaggcctcggctacctttcggtaattctcaggaattgatcgcatcagagtacatcttttccagttcttcgagtagatcaggtgagtgaaccatgacaatgtctttcggaggacccatcttccatttctggcgccagacaaactttcgtttgccatggcgactgactcggcgacgatcctttagcctgcgagcgttcgcagtgactggaattgttacaacttgaatggatacttcgcgcatattaggtccacatgtgcttacggagacggatgatttcgttcatgtagaacgtgtcttcggcttcgagtttttcttcggtttccggcttgtagttggtgtagcagtctgcccagaatcccttacgcgtcttagcccaacggtagcatttgtcgaggtcagcgtacagcttacgtcggcgtgcgtagtcttcttggtcttcggcattgagtgcctttccgccgcacgggccttcgtagtactcgaactggtagcgagtcgacttctcgccattgtcctcttcccagaagtggatcatgctttcgaagatggcggtttcgatgatgaagtctttgtctacgaaacgtcgcccgatttctttcgtcaaccatttctggcgcggattgagccgggtgtcgatttccagccagaggttcttgaaccagtgtcgtacgtcgaaccacaggtcttcgagctgctctttcacgtcgtgtctgttcattgctttatcctataggtagatcatttctattcaaccaaagaaaaagccaggaccgattaaagccctggcttttgacatcttggagcgagcagcgagattcgaactcgcgacgacttgcatggcaagcaagcattctaccagactgaattatacccgcaaaggtttagccttcgccaacagcagtgaagctcgttgtatctgacatatcattttcctttgtttggtgcccctagtcaggatcgaactgacgacctcttccttaccaaggaagtgcactgccactgtgctataggggcgaatttgttagtaccactcttcaccaaactcacgcttttcccaaatgatcagagatttagaatgagtcgaagaagttgtgcttcgaagctcctcaactactcgatcggcatcctcaggagttgcctgaatcgaatgaatatgtgaactacgaggccctcgataagtcttatcaattacgacgtaaagcatcgtccaccttatctggcggacagcagagaaatcgaatcccatacctttcggtaccaaccgctttccaagcggtgctgactaccaagtcagattactgtccatatgttctatttacagctggaaatctttcaatgccatatcagcgggatagacattgttgttctgcagagtcgagcggcgagtagctgggatcttcttgtactcgtaaccagcttgaagctctttcttcttcaagttgtagcgttcctgttccgcatgatactccggtgtattccaacgagctctcggatatgggttttgcttatactcagcattccaatcgtaatgcttgccttcggcattcacaaagatggtcttgatgtaatcaagctcaacgacacaatttcccttgcgcttaccaaggtaggtgcctgcgtgcatcttcgagcgtccggtggacgtggtcatcacgatgcagcgttcaccaggcttaacaccattgtgttctacagcttcaatcggtccactacgactcataatctttccttgtttggcggacagcagaggtctcgatccccacaccattacgtgcctaccgatttcaagtcggcgctagctccccggctagtttactgtccattgttttggcggattgctgaggtctcgatccccatgcccctttcgggcacctaccgctttcgaagcggtgccaactccctggttggttaacaatccatacgtgatatttatcggtcagcaacgatcgctagagctgacccaatcaccaacttcaacaccaacttcttccttcagatattctaccatgtcttcatcttcatgatcagggaggaacacatcataggtatggtagttgatggagaaagagaacggggtgtttgtctctacagcgacatcctgaatctcgcgcagcttttcatacagctcttcttccagacgttgcagcttagcattgctcatgatcaattttccagttggttgattacatcgttgaattcggattccggaatcgcttcaaagaggactccttcttcctttgcctgacggtcgaacgagttaaacacacccgaggtcgccacagtcaaagtataacggcgaatggcttcttgtgtaggcaggacataagtcgaacctgatcttgtttcaacaactacccaatcgccatcgaactctactacgcgtttcagagcagtgctcagacgccagctatcgccgtagagatagccaccgctccatccaccaagcacatgaacgcctgcagaggtgcgaacgaggatgaagctatcaggcttgttgcctttttctggtgcaaggtcttccatcattctctccaactgccatagtcatagacagtttcattgatattccaatgcttgaacatcggatcatctacattgatgaaacgcaccttggcattgcctttggtgaattccatgttgtgatcaaccacgtcgtcaatcagagtaacgcgagcattctttccgaaatgttcaagcctcagcagctggagtagacactcttccttgccaaacaggtcaaacatatcgtcacggctaagccatttccgacgtcgcttaaggatgatgtctgagaagtcgtgcatagagaagatgagttcttcggagaacttcatgccaagcatttcttcgagtggaccttgcaggcgcttcttgaacgtctctttgtccacttcattccatacagcccaagacatcaatcccagcttgcagccagtgtgctgaattgcccagcgaatcttatcgaggttgcctggaagcaggttcatgtgctcccaatcgtcgatcacggtttgctcaagatcaagcagcacaattttcatgatcacatcactcgtgtacgtttcccattttcgtcaatggtgacgatggaagctgagtgatagttctcactctcagcccattccaaagcttcctcgagatcgggtgcccagaatgcaatctgaccttcttcccaatcatcgccgtaatcatcaatcactgcatagtagacaatcatgatcaactccaaattggcggagcgcagaggtctcgatccccagacccgttcatagggtcccaactgtttagcaaacagcgtcagccacctggctgagttacgctccaatgtttctacttaccgagagtttccttaaacacgtcgtagaagtaatcaatggctgcctcgtcgagtttttcttcctcaacgaacaccaggaattgctcagcggcgtttctcaaaatctcgtagttgatgtctgtgccggcgctctgtgaatcgtagccgtatgcagaatccggataatgcaatgcccaggcttccggagaagacatgaaggtaatgccttcccaggtatacatgatatgaccatcatccaagatttcagtcacttcaacaacagagtcgataggtgcaccacattcatcaatcagaatacgaacttgggttaccatagacgaacaggtccatcaaagtggaactcgcaagtgtagaacgagttcagggtctcgatgcggcgtccacgaactgcaacaatcttggacgtgtggatataggtgccatcctcgaagttggggttgccgtagacattaccctcaacccaatgcccgtcgccggctacgatgaacaccgcgcctttgatcacacccttgtcagtcttttcaatcacagtattcataggtcatcctgaaatgtagcatgctgataccttcccgttacggaaagcgtttctaaccaaatgctcacggtactcaatttgatcttgagccgccgcttcacgttcagccatatcaccatgatacacgattggacgttccagtttaggcggcaccttctccaatccatgtgatcggatgtgctcggttcctgctgcacgatattcgggaatcttgggaatgaactgtcttttcttttcaacgaacttcttaactggcttccttgtcggtacaaccttcttcttggctttcttccttgccttcgaagggagcgcagtgtgaactatcataacaaacttggtcaacgggaacatcaatataaatgagaaaatcttctacacaatcgaaatcgtctgctgacagagcgaattcatctggattacgcatttcatatgcgtgaatcttgtcaatgatttctggcttgaagttttcaacaacgcaacaaccacagccaggacgatatgtcttcttaccacgaaggttgaactgtctcatcgtctctcattatcaattagtgggaaggctggtggagatcgagtccacacctgggttcgccatctgcgcgcgtcgactcaccctttgacactgaaatcgggtatcagccgctctacctttgagctacagccttcataaaacgaatagtaccgagggaactgttccgcgaggagcgacctcatttggttactttaaatccctcttgcaagcagtgtctacaggggcctgacaaccaccgacgattcgaacgcctcctccacacctaacgcggcatggtgcacaccatgtgcttaccgacttgaacggctagtcttacttttgcatctggtgaggcctgcattaatcaatgttctgaagaatcatcacaaaggtcccggtacctgtccacagtgctttgattctgcatactaacatcataatgtccgggaagctatcccagcacagccccatatttggcagcctctaacggtatcgatccgttgtcttcgctttcagagagcgacattctaccattgaactaagaggcatcaaacttggcagcgagtgaaggtttcgatccttcttcttaggcttcaaaggcccctgtcttagccactagacgaactcgctatagaatttgtagctaagttaagggttcccgaaggcttctgagtcatcataccctagcaacatatgatgcaccgtaagctaattaagctaccaatctagtctcgccgcaacctttaacagtccggctctttgcaaggctccaactagaataccttgttgcgtactactttagcgcccttacgccgtttcgtcatcggtttggtggttccactagggattgaacctagaataagcgattatcggtcgctcgttataccagtttaactatggaaccaatttggttgcccgtgtcgggatcgaaccgacgacctatcgcttatcgggcgattgctctaaccactgagctaacaggcaataactttggggtgatcgacgagactcgaactcgcacgcctaaatcgtttggcatctggttcacagccagacttgtctaccattccaacacgaccaccactgaaactttggtacccagagagggactcgaaccctcaaaacctgccttctgaggacagtacgtataccaattccgtcacctgggcaaaactatcttacttctcaaccttggtgaagatgtgctttgcatcaactgcaaaatgaacatcatcaatttcggctgcttcgcgaatgttgattactaccgtatcaccgggctcaacgaatgtcacaagatcattcttggccacaacagtgaagatgttcttgtcaacagacccagagatgataattcctccctgactctttgcatcttcttccctacgctttacgatgacgaaggtattaaccggcttaaagctcattcacgttcctttgtttggtgcatcgtgttggtatcgaaccaacctctcgagctcttcaggcaagcgctaatccatctcagctaacgatgcaaattgtcttatatctgtatttactctgtgacaggatgaacccgttcactgaggtgcttctttgtacgttgggtcaactcgtcgaccacatcatacgatactttgtatcggttgaagtgtacaccaattacttcacctttgctcccaccatcaagacgaccagcgagaaccttatcaccgatttgaaaacgcgaaggcaacttcatactacaatctcctctcctgagtattcccttattttgcaccgagggacctgagtgacggtgttttggtatcggagacaggaatcgaacctgcgacgcgtaacttttcaagctaccgctctaccaactgagctactccgacatatttggtacccctggacggactcgaaccgtcaatgcctttcggcgctggcttctaaggccagtagctataccaattcgcctacaggggcatatcttcagcacataccaagttctttagcgcgatccgcagcataagaaccagcaaatgccacaggcttcaagtgaggatcaaccatggtcatcgccttgacgtaaccacgtgctgcttccattgcgatacttgaacctgccgtcttcttcgggttgatgtcgaggtgaatactaacctcgaagtcatagaagacatccttgaaacgatcatgaagctcagctaccttttcagcttccttcatcatccgagtgaacggctttgaaggatccctgtcgtagtcttcctcacgagttgtctcagcgaacaccttacaacccttgcaaccatcaatgtgaacaacgatgacgacggtataatccgcgtacatctttccattgacttttaccttctcggagtctgctccgagataaacttttgtctcagggctctgcgtctgcatgaacgcctcgactgctttcacgtcaattttcttctgcatgaccattacctgctgacaattataggatccgggcgatactgtctcggactagtatgtgagtactttaaattcgccctagcgcttaacgtccaagtgggtctcgaacccacgacctgccgccctaaatggcagccgctctaccaactgagctactgaacagcgattctttatcgcgaggtcaattcaaacttctcaactctcgcatattctttataccaccggtgtgccttactatctgcgttgtgcttgtctgcaacttcttgcgccaagctctcatctagagtagtacacagcactttcctttcttccgaccattgctcaggattcggatgacaatatgtttcggtgtactcataataagtttgatacacgtacatcacaacacctttttgatcaatgatcgcggattgttgaacctggatgtgccttcttaatctgtgtcaggaagtttctaaaatcctgaggagccttctgcctgccaagcgttgttggcttcacatgaccccatgactgagatgaagcacctgaatcccaaggagcatagttgtaggtcttatttccacaactcgggcactctgcgtctttgtaatctacgtcgaccttttcagtatcgccggtccagacatcaccgcggtgctcacattcgctacacttgaaattgtacttcggcatatctatctcatgttggtggacccggcaggattcgaacctgcgatgggctttcgccgtcggattaagagtccgctccgttcgaccaggctacgggaacgagtccattgttggtgggtccggtcgggatcgaaccgacttcctactgggtaagaaccagttgctctgccatttgagcttcggacccgttgattggtagcgcagggaggagtcgaacctccatctccgggttatgagcccagcatactgccgttatacgaccgcgcgtcaatttaggggcacttccgggaatctcaccctcagcgccatagttggtcgggataacggaattcgaatccgtctgactctccggattgacagtccggcgaccacacctagcagtccctatcccgatttgtttggcggtctatacgaggctcgaactcgttacgccggcgtgacaggccagcatcttaacccatagactaatagaccgtttgttttggaggactacttgagaatcgaactcaacaatctgcagttaacagctgcatgcctacaccagttggcctgtaatccatatttggctctggaccacggaatcgaaccgtgtcggatatttctatcgccgggttaacagcccggtgcctccccattaggcgcgtccagaataaatcagtgccagatatatttcgagtctgtgacacaagccttaccgcgatgtcgcgaagcatgtgccataggactatcatatcccagcttgtctagagttcggagcatgtcaaacatagcattcctaatctgagacttttcaactcttaattcaacaattggcttcttgtcagctgacctgatgttcctgcatccataaagcccattgcctagtcgtgtcactttcgtttccaaagtttccataacacttctctaattggtccgggttgcagggttcgaacctacgacctcaccgccccaaacggcgtgctctgccagactgagctaaacccggataaaacttttgtactactctacttatatggtacgcgaaaatggaatcgaaccactgacctccgggttatctacccggcgctctcgaatgttgaccgtaccgttattgtcggagctaggatctcgagctccaccttcgtatcgtcacagtcgtatcgccaatcctcgactcgctctgcgtgacagtatgcctaccgtctttgaacttatcgtcgccactgagctacccgcgtataaaacttggcagtcccatcgggagtcgaacccgattcttccgcttgagaggcgggagttctaaccaatcgtaaactatgggaccaaaaattgcatttcgcaaaaacttcaattgaagcgtttgaggaatacaactccttgaaacaaagtgtcgacctgagaatacagtctgacgagacgattcattcgtttggattatcagctcttgcggagcccttcccaacttttccacaacaaccatctttcgatgcatcattgttaaccgtcatggctgcctagtttaaagaggtggcgtttcctctgtcactgtaagttactctacctgcccgtttcccttgaccttgcgagccattcagaggggcttcctcttaggtgcacttcctgatagacaatcctcagccttgcgagccttaaattgcgttgattcactttcgtgtcaacgtttaagccactttcacttacagccgaaccagactttgcatttggtatagtctgcaggattcgaacctgcgtactttcgtttaagatacgaatgcttatccactaagctaagtctaacccactaaggacgagctggttcgtaagtccatacccttttggggtacagcttcttacccgcccttctctacttttcatccgctaggactacgattcgtagagctctcacgacccattacagaccgttgctgctgccaatcgcccttgcccgctaaggctcagactacgtgacctccgattctacattcatcgcgctcgtgtttgcatgtgacctaggctttgcgagcctgcaacccctcagcatacgccattggaattggcttcaatcaccactcacttcgattatcttccaggaatgactacctgaaatgttcgagcatgttgctacccaaactgcatctcggctatttctagtggaaccgtttccggcggggcgcttgtgggcgctttccccattaggcacatcactgtaccgtattcctaaaccgtcacctttcgatgactgagttgctagaccagacgtctcacgaggctaatgtttgtgcctctcgacgtttcgtgcctttgtttatcgtcccggcgactcttcagtggtctggaccttacttcatgttgcttattgtataccaagctgttttctacacaacctacagctggacacaatcaccttcaaacaaaagctcaccggtttccttgtctttgaccttcatccaaggcgaaccgcaacaaccacatccgcctagttcaacgtcaagacctttttccagaaacaactgcttgaggtcagtctcatccaacttgctcataatcatttcctttgtttggtagttcctgagggatttgaacccacgaccttcgccttgtaaaagcgttgctctaccgctgagctaaggaaccatataacttggtgtgcctggtaggattcgaacctactacgtcccttttgaggatccggggttacagcccggtgccgtcctccatcccgacagcagacacataaaattggtggatagggttggattcgaaccaacgatgcaattaagcggcagatttacagtctgctggcataaaccactcgcccacctatccatttgaaacttggcgcgcctggaaggactcgaaccctcagccatccgggtagaagccggatgctctatcctgttgagctacagacgcataattttggcactccacgagggtttcgatccctcttctacaccttgaaagggtgtcatcctagccactagacgagtggagcaaaacttggagcatctgacgggactcgaacccgcattcccgaacttgaaaggatcgttgcctattccaattagcagacagatgcgtttaatacttgttggcaagctcagcaaacatcctgcgctcgtccatttccttcttgaactcagcctcggcagctgccgcatggcgcgcctggatgatgctcttgatcgtttgttccttggtcatcttgttcctagcacattcgcgaacaacgtctgcgtctgagctataaacctggatgttaccgtacttcttatcacctgccagacctgtcgccttcatgtaatcgcgatggtcatcttcgtcatctgcaattgcgctaaagctacaacccatatcgacttcctcatgattaaaagcttggagcgggcaacgaggatcgaactcgtctctctagcttggaaggctagggcacaaccactataccatacccgcataaaacttggtgccccgtgagagactcgaactcccaacctgctgattacaaaacagctgctctgccaattgagccaacggggcataatttggtgggtcgggtgggattcgaacccacgatcgccggattaaaagtccgatgccttaaccgcttggccaccgacccaaattaacgaagaatccttttcgccactctcaggcgtccgactgtcggagacatcaaccttcgagaggtcttgtcgttacaagtaggaaacgatgtctttccttcttagccgaagaactcgcttcgggcttgtcggcgtgtcttttgatcgacttgcctgactgtgttcacagtctaaatgaagcaaacttctatgcaaccgtcaatgctgctctgattcggtcaatccaatctttgaagacatcgtcatcaggaacaacttcctgatcgtaaaacgactccatttcttcaacaagaacttccaactcttcgcgcatacaatcctcattgtttggtaccctgcaagggactcgaaccctcacgcctttcggcacatccacctcaaggatgcgtgtctaccaattccaccaacagggcatatctaaacttggtggagcttgtcgggatcgaaccgacgacatccagcttgcaaagctggcgctctcccatctgagctaaagccccaagttttggtggaccatatcggactcgaaccgatcagacagattccttgcaaaggattcccgggtgccctgcccatagcccaaaattctcgatcgagttaatgactccatctcgtcaagggattcactgatttctcagtttatcctccaccactcggtttaagtccgagaactatttggacccgttgacaggattcgaacctgcatcagcgcttttggcgccactccagttacctttgtagacgttcgtagcgtctggggatacaacgggataaaaacttggtctgcgtggttggattcgaaccaacgaccactcgcttccaaagcgagtactctaaccagactgagctacacacagataaaacttggagtctgaggcgagattcgaactcgcacctcatggctttgcaggccagcgcatttgccgttttgctacccagacataaaacttgcaggctctgcccctgcttgactcggcgatgctttgggcatccatacaatctgtaaccgaatcttctaaatttggcacgccgtgaaggactcgaaccctcaacacccagctttggaggctggtgttctgccaattgaactaacggcgtataacttgaatctttgtttttaaagaacgtcgcgtcagcctcgttgctgcgcgcctgttacttcatgttgcgtagtttacatcaaactgttttctacacaaccttttcttacatgtttcctgaaacggttcctaacttcatcagtaggtaactcgttgcccaaaacggctgcaacgtgccaaagcctaacagaaagtttgttaccgtcaagtacaagtttttcacataagctcctcggcgcgtcaatgtttaagtgctgaacccatatgctacatggacagcctttcttatcaaccttttcgcaccactaagtaaaaacccagaaacttttcagcttctgggtccagaaattcaaagttgaaaatcaatctttcaaccgtctccgtacccattgctaaaaccaaatccagccacatatcgttcgtcagcgggcttgacagctagagctgcaacctgatgccaatttttcgatgtgaggagaattgttttcatatgagtatttatgccgtttttctcagaatagccgagaagttaggaacaagtcctttaacttttctaccgctgcatcaaagtcggtgaacacctcgacacccttcgcctcacaagcgatacgagcattgtggaagtgcgagtattccggatcaatgtagacaacgactgcaccgttgctggaaattgcaatgcccagttccagcatcactgtaggcgactttgcatccgcaggaatgcagatgaagtggttgagcacgcgagtctgccaaccaaattcccaagcgatgtgcttgttcttctctgcgcgggtaggttcgaattcatcccaatcaggacgacaggtattgatcacgactgcatcggtatctgcaagagcagtttctactttcctctgccagtcacccttcgcagtgcttcctccaaggaagataggcatctgcttagagagtgtggtagggtaattgatgattttcatacttcacttgccagtttgattttgaatgcctcgattgctgcgtcgaggttactgtatagcttgatgccttgtctacggcagacaacttcaatgttgccgcggcgatagaagccttcttcgacacagatgaatagcttgtccggatcctgttcaccaccaacgatgtagccaaactccaaaagagaaataggagccttgctgtccttagagatgaacatgaaaacatggttggagtgctcgataaaatcaagctcccaatcaacctggcttcggaattgaggatcgctatccttctgctgccacgaactgtcccagtcatcacgacgaggattgtagatcgtgccagggaagtattctagttcacgttcaaggcgagtctgccattcaacagctgagcccatatcaatggacccagccaggaagacagttggtcgctgcggtagaccgcgaatacgaacaggtgccttgattacgtgcatcagcaggtgctcggttcccagtactggatttcgtcacctacatcccagtaaccaccgacgttccagtgaccttcccactcctgaccaaacttagagcccaggtcagtgatgatctcgatgatctcttcttcatcatccttgtcttcggggtccagcttgagtgcttctaccagacccagaatttcctgcatcttggcatctgccacacgctggagttcgtagtattccttatgcaggggcttgccggcttcaacagcggctttcacaagttcaagattgctcattgtcatttcctttgtttgaaagattagcaggtcgaaggctgccagtagccaccacgttcgccgaaactttcaaactgccagccggcggcgtgtccaatttcatgagccagttcataggcttcatcgagctgctcgtcagtgaatgaagaacgatcgacgttcctgacaagagcatcagcttccttgaacagctgatcgatcaaggccaggcgaccatagaggtccgtggcttgttcatggaaatcttcgaaagagagtttagtggtcattagcaagtactcggaacccagaagtggatgttgcccggctcgaaaccatcccactccagatcaaaatcataggtcaggtcagcaagacgatcgtttacctcttcgtgcagctcatcgcgctcatcttcatcttcgatgttgtccaggctgatctgatttgccagcttctggaacttgcggcgcagatcagcaagctcattgtacttagcacaataagcgctgtggatgggttcaatctgcttttcaaactgctcaaaggtaatgctcataacaactccgttggttgatgggttacagcgtcaatactgaatggtataggagtactcattctgtgtgcttagttcacggaacacaatcgaatcaattgatgcgagcttgatagtctcatcaaagttggaagtgagccagaacagaagtcgttccagaacaggctctgagccactcttgatgatcagcatcttgcgcatgttgagacctgaggaactattcgtgttcagccaatcagcttcgacgatgattgcctcaggcagccattcggcaagaatcttgttcacatacttcgtgtactcgacacagacactacagcgaggatcgaaatcctcaccgtgatgaatctcataggcgaaaccgatagtctcgccttcccttgtctttacggatgtctcgatcatgccagagttgctgcttcgatcttgatcaggtcatccagggtgtcagccttgtccttgtccagacggatcgaaatcatgcgcggcaggaacagagactgcgtatcgcgaccacgagatgtgatgcgctcgttgtatcgcacagtgatgatggtcggcaggtccgtcagcatgtcatcgcggatcgagtcagggaagtccttgaagatgccgacgtcgcaagccacctgaccgcattcggactgaaccttgagtgcgccaactcgcttctcgttcttggttcccttcttaccgtagtcaaagccgacgacacggaactccgcttcgatctcagccttgaactttgcctggaacttgactcgctttccttcccagagtgcatcatacttcttcaggatggtgccttccagtccagctcgacgagcttccttgaagtgagccagagcttcttcatacgaatggacgatgcgcgattcaatcgcttgcaccttgccttcgaaagactggaccttggcgaaacgctcgttgtagggcagagttttgtcttcaaggtcccatgcaaccagggtcaacatttctgcttcttccggactgatggttcccttgatggccttgttcacaaagccgttcgagtccttacgattcaaacgcttaccgtcacggaaacacaccagctcaccgtctaggctatcgccgggctgcaggtgctttgacgcccactcattgaaagaaccgtggtgagtaatttcgttgtctgctcggctggtcagggttgcagtctcgccatcccattccagacgacagcgagcgccgtcttccttggtctgactgatcgccgggaagccgatctcttcttcatcgtagtctgccgagcagagcatgaaggcaggctttgcgatcaggccaggccagcaacggttcgccgtttcacgagtgccaccgacacgcaggtcgcccagaatgactcgcttgagcacttcggcatcggacaggtacagtgaaaggaacagctcacctacgaattcttctgccttattgccggtgatcttacggttgcagattttagcctcaagctggtcgaaggcgtcatcgagagttacagctccaggagaacgagcccacagagcttcgtcggggatcttacgagtccagaagaggatcttcttgtcgtatgcgagcttgaacactcgcttgagcgtctcattggacgcgttgtccttgaggatcttgtctttggccagtcggctcgacgttgcagccagttgatcgagaatggaaaggatagtcattgtcatctcaaggaaagggaataggggccatccttggccatgcacatctcagagtgaaacttcgatctcagtcacgctgaaatcgcgatcacgaatgtatccgtcaccaacagcatcttcggcacgagcaacatcgtatccgccataggtacgaatgcgaagctgctcttcaccattgcggtgacggttgatcaggtttgctacttcattcagagcatcagccttgtctgtaaacagaacgcccttgccctttcgccagttccgaccagtgcggtatgcacctgcggtgttcggagtgtagaaacgattggtcggggtgtgcttgattgcataaagagtcgtcatgatatttcctcaacagagtccggaataggacaagactcatgctacaggtgatcacgtcctctctacatcattgtcagacactgtatcagaactcctggtcttgtgaagagactcgttaaagtttcgttgtcagcccgtcacgagctgtaaacgctaccttcatgtgcctgacccctaatagaatcagacacttacgtggtaccccttcctgaccagaactccaacagaatcagacacttacgtgaaaaactgaaaaatctgaacaagtctgacggtcatagggctgcggcgacactcagctttaacgcagcccttcacatgctagtattggccagcattggagggtcttggactgtcagtgcagggctacgaaagtcaccttgccctgaaccttgacgaaagcttctcggtcctcttcgccaacgacgagactgaactgctcttccgacagggcatcggacggacgttcttcttcgcgggcaaaactggacggctcgatccagcggttgccgccatcgatgctgattagggcgtacttgagccattcgttgttcagtgcatcgccctcgaccatggccaggatgtagtacccaccatgttcacccagtcgatagatgtcgcccacttggtgcggatagttgctgtaatcacgaatcatgccactgctccaattgttcggaattcaatctttttctgtaggaggcgagcgttgtcgatcgccactttcattgccggtgttacggagaagtctacatacacggctacgatgtccgcaaccttgagccaactcaactgggactggagtccaatgtctcgttcaatcggatccttttcgctcaagactgagtagtagaacagatgcgatgcgagcggggcttcgttcttgttcaacgagtccttggtcgctcgagcagcgtacctcttcatcttctctgccagtgccggatcttccgccatgaagggcgtgatgacgatgacattctttcgcggctgcttcgtcaccctcagattgttttctggcgttgccgcttggatgacggacttaggcgcagtcgaacccttcgccggctttgtctgacccgcgggatcgtcagatacctgacctcccgtttggtacagattggtcagaattttctttgccgtgttgtagggtaccttggccacgtgtcggtctcgattgagttgtcgagatatttaaccccggtgcagttgatgcttctcgatgttgtcgaggatccagtcaatgcagttcagccgaaccttcagagattcgccctgccacttgttgatggcatttccatcgacgtcttcgaacgggaaaggatcggtccagaaaacgtttcttttcttgatgccccgaacctcagcgttgaacatcgccgccaggctgaggaaggtctccccagcatcgcgccaatctccaccaatctggaagcctgcgttgaaacagataccggcttcgggtcgggtgacagttccgaagaaatccagttggtacttgaggtccagcagagcttccttgaccatcaggaagtggtagctcgtggacgagccgtccctggatcgcaggttgaagaacttcttccgacgacggggttcggtgacgtttttcttccaccaactacggatgctcacttgtccgccttcgggaagcttcccttgttgaatgagtggttcatggtctgctgctgaatgaccatttccatggcgtcgcgcatggccttgaggccaccgacaagaaaacgctcagtgacgtactcatgtgcccatgcaacgaactccgagtaagtcatttcgcgcgtcgacgtcttacaagaacaacggctcatcacgatctccgaccaatgaaaaagccctagagatttctccctagggccgttgtgccttaggcggcgtccaggaccagaacttcctcagccaaccggctgcccaccgagatcgggttgcccttcttgacgcacttgcccatccagccgaccagttcttcggtcgtgttcttgccgggctgcatcgcgtcgccgtagttcttgagcagagcgaccttcgacttggagtggtcgatgttgtggatggtcttgcccttgatctcgaagccgttcttcgaatccgagaccatccgggtcaggcgaccgtagcgggtgtcgaagaggaatgcgaccttcttgccgttcaggatgtggtcagcagccggcaccgggtcgttcttcggcagcgtcggggtcttgggacccttggcgacggcgaccttcttcggagtgcgcggggcgcgtgcctggcgaggggtcgaggtgtcttcgtcgccgtcgtcggagttgtcgttcacgacagtttcgacccgcttcttgacttccttcggtgccttttccggcatcttgccgccgttcatcagcttcatgacgtaggtgaaccactgcgtcatgtgcttcggatagatgtcgccgtcttccttgatcgcttccagttcgcgctgacaggtctcgatgaccgatgcagtcgaatgtttcggatcgaccaccagatcgggcttgacgaactccgtcgcttcggtggccttgtccagggcgtcgcagaagttacggtagttcacgttctcgttcgacatctttttcttcctcggcttaatttgtttcggttcggtgattggcatgctaagttcgttcacgaatttcgcaatcgaattcttctctgcctctggaatcttcagtccacggcttacaatacgcataagcgcaccgtaagtctggaacttccattccggctgtgcctgtacgcgctcaaggctttccggagcgaactttttcgcccacgtaatagcatatttcttgagagtttccggcgtcgaaattgccgaatagaagttgagtgctttgaccagttccagtttggtcggctcgacgtccaagtcccacgtcggctctctacctttacctgtcgcacgatctaacagctcgcgcctgatcgcgtctttctgtgtcttcatgttgtccccatgttggaaccccttcgatcagtccgactggtctttctgcacctgtcgctgaccacaatcgaatgttaatgaaggtagcgtgtaggcacaacctgaatcttccgtcaattcaacatgctaggcggctcaagggttctgaggccctcttcacgaggttctgacaagaaattgacccgttctcagtccaatctgaaccaaacggcgcagatgttaagaacgagtcaatttctgactctactagagtcagttttggacagttttggaagaatcagacacttacaaggtgctgacgaaacgccgccagatcaccaatcaggacatcatccttaaagacctgaggaacagcccgagccgaaggagccttcgagaagagatcctcgcgggtgtagtccttgtccagcttcaaaactttgaattcgatgcccttcgactctgcgagtgaggcagcggtgacacaattcggacaagcgtccttcgagtagatctcatacattggttctgattcctgtttcaagtaaaaattgtctgcacatctttgccacttgccttagcatggcgtcatccatcattcccatgtgacagtcatccgcagagagacctgtcattccttgcagccaagcatacgcgcgtgtgcgtgtcatgtagccagtcttccaaatgggatcgaagaaactgtgcgccttggactttagcttacgggaagcggcgttcgccagtcttcccataggcacctgagacgttccatgacaacctacccaagcctgacatttcaaacacgcccagaagtagagcgtgtagaggtcaggacggtgtgggtagatcgtttcgcccgtctcgagagttgcttccttattacagtacgggcaggtcgccatagtcaatagtgctcgtcagtgatccgatcacgtagtcggtggattccaattcctgcagagcagtctgcttcgtttcctgcttcacatgcttcaagaaccatggaataggatgcgacttaggagcctcaccacgatacttgatgttgacagcatccagacattcctttgcagtccagtctacgaagtgatggaggatcttcacgttgaggccaatgatcggaccttccttgaagagatacactgcccagttcttttcttcctggatgacctcttcatacatcgcatagacttcttccgccatttcatcgcggatcattgcgaagtcaggatcttccttgcatacctgattcaggatgtaggcggtccattctttgtgcagcaactcgtcctgcaagatcattccgatgatcgtgccgttgccgatgaagagcttgttctccatcattgcaaaggacgtggcgaaactcaccatgaagcgaattgcttccagagcgtaggatgcgtgcagagccatccagatcgcctttttgtgctcgatgacgtcaacattctcgccgcgcgccttacgaacgttcaattcatcaaggcgtccgtagtagcgaccaatgcttgctgccatatcaatgatctcctggttctggtgaacctgatcaaagatttcgcctgggttcgggtagacgcctcggatgatatggctgtagctattggaatgcaggttggtctcgaagaagccccagatagacagcagcgattccatctcaggaagagacacaaccggtccgaaaatctgcagaggtgctcgtccctgttcactgtccagagttgtctgacgaagcagattgctcgtaaaggcatgtcgacctgctggagatgcagccttcatgtcctgacggtccttggtgacgtcgatttcctcaggtacccagaagaatccgcgctggaccttctcatactgctgaatcttcggatacttcaccttgtcgaagcgctgcatggtaacggtaccatccaggaacatcttgcggtcaaggtaatttgtttctttgctgatatcaaactgactcattcaatctctccacgagctctcatttctgcctcacgggcgatgatctttttcatcgcctcttgaagcctatctctatcctcctgagtccaggggcgtgcgccacctggaataggacaaccaatgcttactttagaccagtcgatctcagagagtacatgctgggcagtcttctccatctgcaacgacctcctcgactactgtttctactttcacttcatccagaccatccttcgatccgcgcttgttcatcagactatagtacagagtctttccgccccagcgatggaagttcatgatgttcttagcaaccagtgttgccggaatcttgttaccttcgaagaacgccggattgtagaacgtgtcagtgctcagtgactggtcggtgaaagcctgattcacagctgccgtcatcaggtatccaacgcagtctcgctgattccacatgagaagtggttcatagcgatccttgagcttctcgtactctgggacaacctgtacgagcgagctacccttggattccttggtagagatcagtgccttaggcagagccataccattcgacgaatcaaccacaaccgacgagctttcaactggcgccgttgcctgcaggaggccattacggatgcccgaaactttaacacgctcacgcagagcatcgaagtccagagtcagctcaatcttgtgaacttcatccaggttaggagaacgcttgtcgataggcagaatgccttctgcatacgaagtgttcttccattccttacacggaccacgctcttcggctagttcaatcgaagcctcgatgcagtagtagtgaatgtgttccatccacttagcaaactcagcaagtgcttcaggctgaccataggtgtaaccacgttgcgcgtgccagtgtgcaaggtcggtaataccaatgcccagaggacggaagtcttcattcgcattcgcagcctgaggtgacaggaagatctgataggacagcaagttgtcgagactgcgaaccagagtacggcaggcgccacgcatatcctgaggcttcttgaacttgcccatcacgatcgaacccaaggtgcagagtgcgatgcgaccttcttcatcttccaaacgctggaacggacgagtaggcagcaagatttcctgacacaggttcgactgatagataggccaggtcttcgaatcaaccggaccttggttaatcacgttgtcaatgtagacttcgaagatacgaccagtgtctgagcgctcagtcaggaatgcaccgaaggcatctgctgcattgagctggcgcttgcgcagtccatcctgcttctcatacttttcgtagagtcgaacgaactcatcctgatcacggtagtatgcctcatacagatcaggcacttcattcggatcgaagaaggtcatcatctcctgattacggaaacgattccacaggtacttgcaggtcacaaccgaatagtcaaagtgacgaacacgattctcttccgtaccctggttgttcttcagaacgatcagttcctcaaactcgtagtgccaaatcgggtaggtgagtgtcgcagatgaattgcggatgccaccctgagagcagctacgcatatcactgaaccacttcttgatgaagagggtcaagcctgtatgagcaatctcgcctccgcggataggtgcaccggcggggcgaagacgtccgatttcaaggccgataccagctctcttagctgagtacttcgccaccatttcgccagtggcaaaaatgctgtcgagcgtgtcgtcgcttcggaggaggacacagcttgagaactgcttggtaggagtgccaagtcctgcgaggacaggggttgggagtgtaaattcgccattggaagcctgcttgtagtattcgttgatgcgcttcattctgtgcttggcaggctcagcgtgcattgccgtcgccgcagctacgatgtagcgaatctgaggagtctcaacgtattcctttgtggagcggttgcgaaccagatacttgtcaatcaactgctgaattgcagcatgggacaggcgttcatccttggtgtggtcaacaaacgtctcaatgaggttccactcatcttcagtgtaccactcaagaagttctgcagtgtagagacccttatcaacgttcttcttgatgatcgagtaaagagaaggaacttcgtattgtccgtagacttccttacggagagcatacgatgcaagacgacctgcgacatattggtagttggtgtgaccctcttcgctgaggatcaggttcacagctgcacggatagccagctcatcaatgtcagatgtcttgataccgtcaaagagttcaagatccattctcagttcaatcaacgactgagatacatttggaatcccatcacatgcgtattcgatctgacgctgaatctttgccacatcatacggctcacgcttgccgtttctcttagttacattttgttcttttcttcccatgccttacacctgacttcctcaatatgacggggtttttatttacccacaagctatagtggttataatacaggacacccactatgaacaatagagtatcaaggacttatacctgaccaaccaaggaaaagccctgaatgaacagggctcgtttcaactggtggctatgactggattcgaaccagtgtgaaacgccttatgaggacgtcggctaaaccgctcacccacatagccaggtttggtgctctcagacagagtcgaactgtcttatccgcgttacgagggcggcgtatcaccatcaatactttgagagcgtaattcttgaagttcccttttcaattcagccaggtggcggcgacccatgtcaagccaacgacccgaaccataacgttcaaggacaccttcgtagtgcactacttctgctgcctttgcagcgatcttttcttcgtttgtcatcttggtgcctcaggtcggactcgaaccgacaatgacacttcgttttgagcgaagccgatataccaattctctactgaggcgaattctgtgctagtcatgttccttcgataaacgtcgttgcagcgagatactagcggaactctctgcacccctgggcgcttatgaagtttggtaccctaggcgggactcgaacccagcatggctccgtcgagccggcggtttttaagaccgctgcgtataacctttccaccactagggcaaaacttggtgcgtcctacaggacttgaacctgtggccttctgcgtgtcgagcagatgatctaccaactgatctaaggacgctctattcttttatttaccgaagacttcttcaaggtcaacgccgacagcctttgccacttgcttgaggaaggcgatcttattctccgtctcacagtgaggttcgttgttgtccttgtcgtacttgatagcacgctccagaaggtccttcagcagttcaacttcccttttcaggagttcaaactcttgacggctgatcgtaccgaacggctgcgagacatcaatgcggcgttccttggaaggagccataggcattgagggaatcggcattgccggaatggtccaatcactcgggaggcgatctttccaacgttcctggaacgagtcaccaatcatcgaaacaacgcacataatcaaatcctcaaaggttactttttaggcttcttcttagccacatggtcagtacgaatcagaacactgtgatgatcgttctttccgccgcgctttgcgctaatctctggacggttagagatcatcaccgaggtcttacccttttgatacatctgtccaaacgcagatggagtgtgcttgtatcctgcacctaccaatgcgttatgcagctcagctgccttgtcagggtggaccgcagagtgttcattgatgtgatacttggtcacttcactttcgcgatgtgttccaggtgtctcatgtgcagacacaatgtccgaagactgatcgtgttctgcgtggttgccttcacggttctgagggatgttgatgtggtgatgcttcaggttagcctcagaaccacgaacatccacaagtttatcatctacggtcttcttcaccaccttaccggtcttgtcgcgccaaaggccatagccggctgcggacaaacccagtttgtgtgcttcctcagccgcagctgattctttcaggtaggtttcaaaactcattgattggcctttgaatttggttccaagatcgctctgatcttttctagtttcgcattacactccacaagagcatcgtgacggtcattggcgagccttacagcttcatcaaccgacacagtggtcttctgtggcacataacacggttccgtcaaatccaaaggaacgtgcttacatccagcgagaacaagtgctaacaacaggacgagaattctcatttgagacctcgcagtttacgctcctcagcagccttctttgctgcatcttggcgctgcttttcggtaatgcgcttctcaatgtcgcgcagcgttttatcgcgctcagacatcgtgtcaagtgccttagtcacctcagtcgcactctgattgagtgcaacgtcagcagccttcaccgttgttaccgacaaagattcgatcaactgatcctttgttgcaatcgtctgggtgtaggacgataccaacagatcacgttccttgatagccatcgactgtgtcgtaacacttccgatgattacacctaggaacaaaatgccgacccacatcatgatatcagacaaccatccgtagatgcgaggattaattctcttctttggttgttcgttgtctgtcattactgtgtgccttttcttcgtatttaatctctcgaagattgaaataggggccccaatgaggaactcagtaggggcgaggactgagcgattaggcgtagcgagctacggagtaatcggcgtcgttagcagcgacatttagctagtttgcatcttgatttacttgagttgatactctcaagagtggtctgctcttttctaattacctgcctgtcgaaacctgggcaggcccatcaacaacacacttgccgtggtgctcacgtcatcttactcttgcccacgcttcccatcttgtcagacaccgaaggacgatccgctctgactagagaaagcccgctaaggcgatcaaatgtgttcttggtggacctggcgggaatcgaacccgcgtccagacaacctttcgattggcttcataccactataacttgccagctctttcgagccttaaaccttaccagtctccagaagcgccaccgcctccggaatctccgccaccaccggaccaatccgacgatgaaccgtaatctgtactgcctgacgagaacgaatcaaccaaaattgcagcagttgcccagccgaaagtatcatcactcgagctacggctgtaactgtcctgacggctgctactgtgacgcgtatccctgtgagtgttcaatgcggttgcagtgtaaaacgtctgactgcacaacggacatctgtatgccatattcttcacctcggggcaccactgcccacaaatcatagtttatagaaccactgtgaaagaacaagcctcagtcttcttccgattcttcgatcagcatttccttagcgaaaatactcatttcgacccaatcatgcggatcggttacatcgaacccagcctcacgagcaaggtcgaagaaatacgtgtctcggtaggtcattttaccacttgccttcggggcaggttgcgttaacgagtttggtctttgcaggcatgaagcaaccgcaagaaccacatgtgagaacgacagaattgaacagcgggcacgccttacaaatttcgtacctgcgattggattcaccaccgttcgagaactgaccgttgatgacgtccttcaacccgtccgtaaaagtatacgacataggtcacccaaataaaacaattgctgaaacaagatcttcatcttgattgtactcagacgccaagatgatttcgtttcgttgtgcgcgggtgatatcaaaatcatcaaacagatagaggtgctgagaaagactttcgcctcgctcatatgctccatctagaacgaaaatgatatactcgcggtctcggggctcaagtgcccgtttctcgtctgtattcatcgagccaaactcccacctgtccgcaatctgggttacggtagactgtggtgactttcatgccaccacagggtccacagaactgagactgctgagtcatcaagattgcctccttattcgcgataaggtaatcgacaatctgttctcttaggcgctcaattctcgccatgcgtccaccacacgatgttcatactggcgacccagcttgacgagctgtgcttcatcgaagccgtaaatctgcgcggtgccccaatacttcggagtcgatgcacgaacgcccatgctaaacaggtcaccggtcttgacgacttcgatgatcacttcgccgttggtagaacaacgtggtgcgccatacttggacttacgaacccagacaatgctgtctgattccatagggacagtagtttcaagctcgaaaccttcctttttaagccactgcagatacgcaggatcttctggcagaggcagaacactcactttctcttcggtactcatttcaattccatgttgaggggttacttcccagtatttactctaccgaagatttcaatgttgcaaatcgcttgaggaagacacgcgccgtttgttcttgggtcaggttcatttcatagaatccttcccaacgacggtggttctcatattccgcaggccagtcgcgcttggagtgttccttgagcgcatcgcgttccgacaggagcagcattctatccgcgaacttgacagtctcatgcagcttgaaaggaacgccaaacttttcagcgattactgcccacaggttatcttccagttccgcataggcaggaatcattcgcttgaacggagttggaatgtcgcacaggtaagcctcagtcgcatcatgcaacagtgcttgcagggcatgttccggcggtacagcgtaggagacgtggatggagtgctcagctacagagtagaagcgatccacatgaccggcgaaacgacacaccttagacagagcatgagcaatgtcctcgatgagaatggattccggatcagggtcaggcatgtagagattgacaccagaccaggtttcgatgaagtcacgttgcatatgatattcctttggtttacctaaaaggacaaaggcaccgaagtgccaatgtcccaccctttcactcttttagcacgactgactcgatgcgaaccattcgccatccttcagagacccacccataccatatgcaggaccatcgaaattgaatgacggctttgcctgccaggaacgcgttgcgccttcatcaaagaggccatcggacagttcccgagcttcctcgagaagaccctcagcctcaccaatcagctgctcaatgcgcttcttacggctttcaaaatcagcgtattccatttctcattcctcagcaagaatggctagatgcctgccattcaccagactcgatccagccacccataccataggtaggaccagaccagtgataggtgtcgttgcctgccagggcgcgtgcctcttcaagctgctgtgcagcgctttccaggagtgcaacaatcttctcgtgacgctctttctcgactgccattacaaaacttccttctgatagagttgccaaccaaaccacattgcgctcacttcttctcgcacgtagttaccattttcgtcccgcttgcagaactcatccttaaacaggatgcctggcttgatccgaagatcacttccgacattcttgatgaaatactgccggaagacagcttcctcaaacttctctcgagttgcgctcttgatgatttcatccaggcgcgccgcccagacctcaccaagctctgcaacctctccaccccaccacttcttagagcggatggccttcgctagttcagatagggccttcattcctcttcctcttccctgtcacgcagggcttctagttcacggattgcttcctcgatgttcaccttgaagcgatgtgctgtatgaccaccaccccaaggctttcttccagaaagacgatgaccggtgccatcttcatcagagacatacagtgatgctccagaagcacccattacaacttcaaaccaggcgtccttcatatcagcaccaactcgcattccagtcgctggactcttcggcaccgagaatgtaattgccatcctcatcttggacttgcaggtcgatcttataatcgacgttgtgcttcacattgagttctctcagctccttatccagttcgttgacaaggagcttgatgagttctactcgttcttcgagattgtctttagccattagcagttactcgcgttccaggagggaggatcatacgggacaggctcgtcatcccagcacgaactgtgcgaccagtgctcagagccagctggagcaatggtacggatctcgtcgatcacgaaatcgcctgggtaagcatcacgacctgaaacgtcgatacgaccgatcagctttgcttcatccatcagagccttgatctcttcgaccttctggatgatagatgcctttgcagcttcagtaagcattttcttccttcacgtagggcttcacattgccgctttcgacttcacgccagaagcggtccacatattcctgattatacaggtcattcacttcgtcaaaattatcccaggcaaacttccggaaccaaccagacgtgatgctcgtgcagaccttttccagcgcggtgtcgaaagccttcttccgctgctcgatagtcttcaggttgaacggaacaatggcgcgctcgagactcagcacatagctttcctcgaggactgccaacagctgcacctcacgtggctgagcgaagaactcttccttcgaagttccgacttcctcaccgtcaggctggaagaagcgataggcaggctggtgcagatgcttcactgcgacatggatgctgtcgtgatcgtagacatagcgaatgccatcgtccttgaagaagtcagccttggtcacaccaccttccagcttggggtgcttatagtcgtaggtccacttcttgcgatccttgagccactcgctcagacacttcggaaccttgtagccgaggctcttgagcatctgaatgtctcgcatcgttttcaggaagtgacgcgagtttttcttgtacttgtgcgacagcttgagtgccagcacaaccgacggagaaacagcgtagtagccttcctcggtcatcttgtagaggccgttgttcaggacgatgtcaatgagggtatcactgacagaatccagccatgcgatttcgatatcgaagatggcgtcgtttccattacgagggaacatgaacagatgattcgcatcttcgctgtgctgaatcttgacgaagcgcgtcttgttctggtcgatcatcgccttgatggaatccatcgtagcaatgaagtccatgtccaggttcctgcgctcaacagcgatgccgtgtgcgcgaagtgcgttggatccaatcagcagagcagtcatcagatgtctcgattcttgaaacggttggggaggtggcgttcttcggtcaaggtgcgcccgagatacagcaggtcagtctcaggatcgtatccgacaatgagacgatgctgtccttgggaatcaaatacccaggtgttgatctctcggcatccttcagcccaccaacggaaacatgcaggtcggttccagacaccagcacgcctgatggtggtcttgaattcttcactcgccttgtagagctcaccgtgctggttgatacggtagagaggcttcgcgtgacgactgaatcgagcagccattacagaattcctatgcgagtgatgacgaggtagctggagtagtcgccgggatcgtatgcgtcgtagcccaggcaatccgtgtggatgtactgcgcctcgatgtcgaatttctcgatatcatcactgccgaagtgttcacggatcttctccatgagctccttcagagtgaccgacgaaaaagtcgtgtcgatgtacagcacatctttcgtattgtcaggctggaaagttctgatgtttccaccgaaatcgttcggacgtgttccgtaacccatgactaactcctaatcaccttagtccatacagtctacagacagtacctggataggtcaaacagaaacaatcggctctagaaattcccagatttcgttctcgtcgtaatctttcgttccaagattgaggatcggaatgcctttgtccaaagcgatagaaagagctgtagctgtaccaccagaaagttttccttccggagtccatgcaatgacgaaagaaacgggagtgacgagatcagcaccaaggacctgatgacagtttcgtgcgtgtgctgaacgagcccatgccttgcagttcttccaatgaccaacatatcgttcggctacgatgtaagcatccttcgatgctccaacgaactcagatgtacgaccattgaatcccttctcaggcagccagatttccttacgaccattgactgcatcgcatcccttctcaaatgctgagtctgctccggcagctccaccagatacaaggatcgcatcgtactctttcgataggtaagatgccaacacagacattagagaacagatcataggaggcgtttgacgagatcctatacctgcatatcgaaattgattcataaaaattgtttttaaaagaattgcggtttattggagccacactttggctattaccaccaaaagtgcgacgatgagaaaagggaactgcgtccataccatcaccactcaaacttgcaatctgcttcccagcaggacgaggtgaacggtatcgccctataattgcactttggtccctcgcgggattcacgccatagacaagaattcagttagtaatcaacttgcctaacacctgttgccgtgtggcagagcaggtcatactttagaacctctcggttccttattctcacgttacgcacttccgacgattgctcgccctgcccactctatctcacgtcgcgactacgcttagccgacggctagttgggcaacctgttgttcatcatataatttgcgtcactggattagtcgtgacgatatagctttcactttactggcttgcccatgtctcgagcattattcttataggctcgatatgagttttccgattcgatgtattcctgggcacgcctgtcagctgattccttggtatagcattcgatcgacccgatgttgtatccctgcttctttacccagtcaccatcagaatctaggaactcatagccaccgaaaaggccaacaaacattgaccagcgtcggacaccaaacctaccgtttttgaattggacaattttcatgcaaggattgtaattgataatttcattcgtcaaaatgaatgctggatatcagatatgaaacatccgattctgcagcaagattttagctgcctctttgagatctttggtttcatgcaaggctttcttgcattccatcatgccataggatgtgtcgaaggtctcaagcatgaatctcttgagaccttcgatttcttccttggttggtttagcagacacgtctcacctttgattcattatcagtatgaacgatctcgcagtgatcgaagagaggcttgtagtctccactcgacaagctacgaacatcgcgcgcttttgccagggcagcaagagtctgccattccggcgtcacatatttgagcatcgaagagttaggcttggtgttgtaattcttacgattacagatcacctcgacccacttgttctcagcatcatccaacatctttaccagcttggtgttgtcccagagagtcatctcattgagacggttagccacctcagccatgttctttttggtgaacagagttgcgccatatccttcccagaacttcgcccagcggctgtctgcaatcatggtaggaccgttgaacagaccttccagtgccaggtagccgtacgattcgttctgtgaggaaacaaaagtgaacttcgcagatgcgatgaagtcttccttttccttaccttgaaggttctgacggatctcgtagttggtgactccagcttccttgaaagccttgtgccatgcgtcgggagctttgatgccaccacacatgacctttcccttgatgccagtctgcttgcacatctcgacaaagagctcaggtcgtttgccagtctcgtatttgccgatgaacagtgcgccttccttgtgcatcaagccaagatggctcggaagctcgtcaggcagcagtgggatgatatgatcgaccttgacaccatgcttttcctgcagccactcagcattcagaggtgtctgagtcacagtggtgacaaagccagacttcggaatcacttcgttagcgaagtagatcacagcatcatcgaaaggaaccttgctcaggctttcagacatcaagccgtggtgagtggtgtagatgacattgaatggctcgatcatcgcaccaaaggaaatgcaagccaatgctgactcagggcaggttgtcacgatcgcatcatagagtttctcttccgtgaacactgacttgttcaaggcatgacggaattcttcgatctgatcgaagttgatcatgatgcgctggaagatgcctggctcctctgccttgatcttgaccatctgaggatagccataggtcacgacattcggatgatcaatctcataaacctcgagattatctggtccgacgcaatgaatctctacgagtgtgtcgtcaggcatcgactttgcaatgcctcgcacaaacgtagagactccaccaccccgtttcggattcaacatgcgcttggtgacgagcaccattacgcgcttccggtattcaatccctgaagaaaacaggttggtcagtgacattagttgtacctcggatcaaaagaatctgcacgctcatttgcagccgatactgcccagctgagatcaacagcacgtgctctcagtctttcaatctcattccttgcctcacgcagcagatggagtgtatcatagtccacctcaccgcgcagataagctaaaatcttatcttcgatcctctcttccatcgtcaagctccagttccacagaaatagacgcaccttcaagatcagctggactgtagccgttgccatagcattcgtcagactcacgaacagagaagctgacccgaccaatcttgagattgtgcttgttgttatttttcaggtgctcaaggatgatgctttcaatctcagccttggacagtctgatttcgctcttgagaatcatttatctcaccttagtaattatgaaggaagctgcccttaaagagcagcattcctacgaacagtatccatgttcacatagtcgaagaaggtatcacgaccgtagtggctatagacaacatagtccttacggtaccaatcgctcgaaggcttgttgaaagcgaacgaatccagcgaaccttcggtgatggtcttccactctccagtttccggattgtgatagacactcaggtcacctgccttcgacttcttgccagggtcagtgaccggatccttgatgatgtctaccttttcgccgttgatgtatgccaggcatgccttcatggcaaacttgaacgtatcacggttcaccttctgcagaagtccgccacccatgccgaatgcgatgttcgaggcactgattccgagattcttgaggtattcaagaatggcctgcacgtcttcgatgtcaatgccgtcaccttggatgacacggacatgatccggaagaaccttgaagcccttctcgttgacagtgtagccgaccttttccatcagtgcctggatgaccttgactggcatatgaaccgggtcaccactgtcaggacggagcacgatagtcgccccagcttctttgacttgttcgatcagggtcaggttggtttcgggatcgatacgggttgcccacatgtcaattgcggcgaaggtatcgtagctgtcgatcacacaggcgaaaatcgcgcccggctttgcatagctcttcaccatgttcttgtaggcgttatactcgccatcgcgaccccagctggtcatcgtcgaatgttccgacgctgagatgctgtaaccgcagacatccgcaccatagtattccattgcagcttcaatacctgcgacggtgtcggtgcccatgaagttgatcaggtgcgcgaaggcgccaacatgtgctgcgccaggagttgcaccacggtatccgaaatcgtgcagcttgaacggaagttccgcatcagcattatccgacgtcaggtccaggtactgcttgatgaccttcttgatctcgcggctcttggttgccacagtcgaggcataccagacatagctcagcaggagcgtctcgatatacgaggtcacccacggcagacgctcgtcggtgttgatcacggaaatcatcagctcgttgagcggcacaggagtgccttcttccaccgagcgaatctcgacaggcaggtagccgttgtggtcgttgacgatcaggtcccaaccttcgcggttgaaaggaacgccgtgcttggcacagaatgcctcagcctgatcaacgtgattcttggtcacgcgcttgttgagatattcatggatgaagatttgcagaccagcacaaaccactgcggtaacgccaggaatcttgctgccacgcgccgtgacataactcttgacgagagtggtgcccttcggatactgcatgaagtgcgagaacttgtagctgtctgttgcaaggatcggattgaaaatcatagaaaactcctttctacgttggtgtgattatagtctaacagtgtgcctcagaaagacacaccgttgtcagcgagaagcttgcgagccttttccagctcggcttctttcgctcgttgtttctggttttctacagcagcgatatcggcacggtatgcctgacgaattacttccttcttctcttcctcagaagcatctgtcaggaagataggatgcaactcgatagagtcagccgagtcaccgtcgctccattcacagagatcgtagaaacttccgtcgaaggtgtagtaagaatgctgacggttcgcattggttgcgaacttatcacgcggcttgtgataccacttctccagttctttgaactccggctcgcagtgaacagaccatgcaagccgatgctggagatcaaacaacggcgtcaggattgcagcagccttgctgcgctgttcttctgcctgtcgctggagtcggtctgcttcttcgaagaagccgtcgataatgtccttcatgatatttcctcagacgccactcagggcgcggtcaatgatctttccgtggtcggagaagatctcacggtagttgatttcgcccaacggaacccagcgtgcttcggctgcgtcatcgccgcccttgaccttggccagtggcttcccgtcagcaagcttgatgacgtggacgtgcgtaatgattctgccacggtcttcttcgctgacaccgccggcacgatcatgaacgaaagtgcggacaatgcagcggcgaagcacatcatcctgcagatggattttcgtttcttccttcagctcacgcagagcgccatcttcgatggattcgatctgatccaggaatccgccgggcaaagcccacagacccttaccaggacgatcaccgcgcttgatcagaagaatatggccactctggataaccacgcagtcagtggtgacgaacatcggcgggaacggcgaacctgcccacgccttgcgataagcctgtatggcgccatactccgcgaaaaactcttcatagatagctgggttgtttttgatgtgattgaccaggtaggtcagagtcgacggatgcaggagacccgttgcgtaatgcagcgtgttcgtccagaccatcttgcgaatgtcggtggcgttgtacttgcggagcagtccgctttccagttcttcgaagccggtgtcgatgtgcttccactgcgggaacatcttgagatagaagctcgacgcatccttttcgtgaccgatcaggacaacggctttgtccttgacctgaggtgctgccatggtgacgagagaatgaatctgtccagcccattccgtattcgaaggcatgtcgtatgctgcatcgaaaattacccgttcacgctggtaggtgcccagcgaatccagaatcatctgcatccgctcgtcgaacgtccagggattcttgaggccacgaggaccaccggtgtcaccgatcaggatgagaaccttcttggcgatcttgaggccttcctcaatcgcatggaggtgacccagatggaaaggctggaaacgcccgatgaaaactgcgagatcatgctgcataagaaaactcctttcttttgctgattataacgatgtatggtttcgtatcaaccgaaaaggcgccggagcgcctcgtcggatacttctacttattaccgcagcttgacgccctggtcaacgccggtctcgaacttctgtgccgtgtcagcgccgaccacaaccttgtacttcgacagatcgaccttcggatagcctgccagcttcatccagaagcccttccagacatagcccaggttcgtctgataggcgcgcttctcatccagcagttccgtctgggagaccttgaactcgttacgaccagcttccatcgtctgctggagtcggttgtagagttccgggttcagattcggattctgttcctgcagccactggaaggtcttctgctcgccggcaccacgactcacgccttcactgccatagcgaccttcgaacgttgccttcagaacttccttcaggtcatcgcgtgcgatttccggaacctgtgccatttcaccgatcttgatcgtgtactggcccagcacgttctgattgtcctgccacttcgcttccaggcgctgctcggcttcgttgccgtagttggctgcgctgacatagctgcctacagcgaagactgcgcccagtgccaggatgcccaggaagaccagcactgcaatccacgccgagcccttgttgctacgaatgttcattatcaattacctttgttgggtttgtgtgattttagattaacgacgaaaaccatttcggatgtagcgaatgttcgggtgcctgtcgtagaactcctcgttgaacacgtcgtacttgtgaagaaggaaagttgtcaccatcaagaggaccaggacaatgcctaccagccaagccacttgctttgccgtcggaccaccctcagccttcaggtattcatagtccttcatgttcttacgatggaagtcggatgcgatcacctttgtgattacagccacacctgccttcgcattttcagtggtaccgtacttctggagctcgtcgcgcatcttgacggcgagcattccgttacctgaggtcttgccaaacgtgaaggcttcgacccagtcgatcttggttcctgtgacgcctaccacaatcaccacatcattcttcttgccgccgagccaagcacgttccagcgtgtccttgtactcccgaccctgttttcctacgaagaccaacacgacattcacttgtcgcgctgcacccatagttttcaggacttcgtcgagctctgcatcccaggcctttctgttcgcaacacctgcctgaatatcaatggtgtggtcaacgcgatagtagtcgtagatgcgtgggtactgagggatgatcgcagccttggactttgcctcggtttccgccagcttgacgttgaacaagctgctcggagctgccttgacatagttggtgtaggtgtgcgtgaccgcagcatgttcaccgatctgtaccgcagtccagcggggaggttcgcggctgccacgacggtcaacacgatcaatctcgaggttgcctaccgttgtgaagacgtcccaatcccagtcgttggaatgctcatagcatgtgctgcaatgtcgggtgcaggatcgacttgaacctgtgccactacacgtcgtgtagcagttacacgaatacgaatgcgagcagcttacccaggtctgcttcttgcctgtcacctgcccgttgaggatttcgtgatcggcggtattgctgtatgccatgcagccgtagatcagaagaaccacgagtgcgataccaccgccctggagcagaccttctttccaggtgatcgtccttttgaacgcgaaatgtgctattgcagcccacgtgatcgggatcaagcagagccagagcgcgatttccatctgaacctcagttcggtttatgttctacaaataatacaggaaatatctttctttacaggaagactgggttgaacttctggccctggtatttgtgcagatttttctttcgcaacctttctacgccttcgaaatgtgcttccatgaagggcgaaacttccatgtccaggtctttcagacggtggtgcgtgtagaaagaaagttcgtcataggtgacgccgaagttttcttcatcactggtaccgttgaccaagtcacctgtcggaacgcgggcagcaacacgctcaggtacgcccaacagccttgcccactcgattacttcgaacttgtgtaggttcgagatcggctggatatcgaccatcatatccgagttcttcccgaaccagcctacgtagcccatctcatccaggttggttgtgccgatggtcacgccgccgagtgcttgcgcgtaggcgaagaagctcaggtaacgcatagcgtagctggtgttggcgaagacgtcatcgtcgctcttttcgaggtcaagagcaaccatcatctcgctgaaagccagagtcagatctttcttgtgccacttcacgtttcggaaacgagttgtagccagctgcaagagctcgatatagtcctgttcaaagacattgctgtaggtgtcgaaatcgatcgtcacagcatggacttcgacttccggaatatgagccaggaggaagagaaccactgctgaatcaacgccacctgagacgcctaccacaaccttcttgatgttccagttcaagaagtagttcttcagggtaagaatcttctgatacggatccttccttcggaacatgtgcttgaacatccgaaccgacatttccagttcgttcgggtttgctgggatgaaatccatgacttatgccggagtgaagatcaggtcgccgcgcacgatgaagcgctggctatccttatcggtgaaggggagcacggtgtggcagagagtgtgcgggaagagaacgatcttgccagccttcggcttgatgcgaaccgtgatctcgtcattggtagcctgacggtcccaatcgcccttggtcaggttcggatcgttgtcgatgaaagcgatctcgccagtttcgcagtcgttgaagtacattaccagcgaatacttcgtggcgtagcgaatcgacttgcccagggaccgagcgtgatcgtagacaacgaaatcgctgtcatagtgagggaaatgttcgccgccctgatcgtatcgcatgaaacggaaatacttcgagacgcattcgaactcccacagatcaccatcggcatgaatcaactgcggatgttccagagtctggatcacttccgtcagcaggtcggcgaagtcaccatcccatgcacagaaacgatgcgaaccaatgccactgtcgatattttcgaggccagtgacagataccggatacaccgcgcctgcctcattgaagttttcgaaggcattctccacctccgggagaaggttgaggctggtgtcgatttcgatcacgccgttcttgtagatccgagcttcgagctcaaacggttcgtctcgagcgatgccaagacccaggattgtctggacgttgggcgagatgatttcactgatggacatggctgagcttttccttgaattcgttgaagtggtcgtggaaggcggtatcgaatgcctgcatgctacagcggctggagatatccgtgaagggatatgcccactctttctttcggaagtcgctgatatccaggagctcccaggcgccgtgccagtccttgagattgatcaagccatgcagctttccgcccatagcctctacccaagcctgcgtggtgccggtgaagatgtccgagtcaagcagaaccacatccttcggaaggaaccaattgctcacagttccgttctcgagagggttcttgaagtagcggctgatcttgacatacggcaagaagccagcgtattccttgcagttggtgtgggttgccccaatcatctttgctgttcgcttggcagacttgatttcatcttccaagaaatacggacgcagagagacatactggtccttgaagtattcggagaacagatcgaactctgcctgattcacacagcgcaggatgagatgcttcttcatccgctgcttgttctcgagcttggaggtgttcagtccagtggtgtcctcaaaccactcgacgatgaccttgtcggtgtagttgttgaggttctggaagtcagcacgatccttgccacagaggatgaccggaggcttggccatgtcgtagatgccagcgcgcttgcccgcagccaggaaggcatccagttggtcagtgaagttctgatcgcatcggttgttgagcatcggatcaatgtcgatcgaggcagtgataccgtgctggctaaggacacgcttgatggtgtcgtagcgatgcttgttcgatgcgagctccgaccatgcgccatacttctgggaagcgtagtccgaattgctcggtgcgatgacgagccatgcgcctggatacttccgcagagcacgcttgatcactgagatgtgaccatcatggaacgtgccgaagctacccgggtagtagatgatctgatcgtatgcgctgatcgcagctcgcgcccagggctgcgagaagatctgattgaagggttccttcggttcgaagtagccgcactctgctgccacctcaggggtgaggtccctgtaaattgctgactccatgactaactcctagtcttgggttgatattatctgattgtcttgccttcgaagagcttgtcgatcttcgcgccgttgacacattcaacgtggtagaccgtcctgtactgctcgaggaacgaaaccttgcctgctgagtatttgttcgcgggtgtaacccatccacgaacaaacccgccatttacagtgcacatagcaaccatctcggcttctgcaccagggatgatttctgattcttggatgatctcgccgcacccagagagtgcgacggtcatcagtgcggctgcgaggagggtcttgatcttcataccactagtctacagatgtggtacgaaagaacaatctttctattttcagcggaatctcgagacagaaactacgtcgagtcgaagctcgttcaagctctcgaaataaccttcccagggaacgctcgtagaaacttctgtcccatcttcgcgaatgtaggtacggctataaccagttccttcctcgagagcctttcgtgcagcctgagctcgctcgatagtttcgaagaggtcgatgaactcgacgtagtttctgtcgtgtccaaagctatcgccagtgttgtaatccgcccaaagcagaatgtaggacttgttgatgtctacatcgaagggaacggtgaggtcacggtaacgcgcctcaggaacgatttcgatgccgttgacggaaatatctgccgcagtgtcatcacggtcccaacgatcctctggatcaccggcgcgcgtgacgtaacgatactcgtcgtaatcgactcggatgtgagttgccatgattagatcctatcttgaatttctgacaaaaggaagggcgatagactcgcccgtgtcctttagaacgtgattgctggtttgatgcgcttgattcggacgtcttccgatgcgccggtcttgagcagttcattcactcggttgagtgcctgggtcaacccagaaaactgctcgttgttcacttcccacttcaaggtcttggtgtatttgcgctttgtctttgtctgttctgtcataacgaatgtccacaggaatgtgtttaccacattcgttattttaaagacttggttggcatctacaaatgaactacgatactagatcccatcttcgatgaagtgcatcttcatgcccgaattgcggaagatgattctttctcgagcgttgatgtgttcacgcttgcctacgtagatggaacctcggctgacagaagaacgaaatgcagtgccagggatttccagcaagaaggcatctgccagttcgcacatggagtggtaggtcttcatgtctcgggaattggccaggtggatgtagttggcatgcccgaaatggaaagccaggagggttgccctcgcgagcgtgtgcatgcctggactacaggtcatcaatccccagggtcgatagtagacccaatcgctcctgtcaagcggttctgctccaaggtcgtgcggcattgacaagccacagtcaaccatcttgtaccactgttcatcagtcggtccggtgctcacagatatcccctgtagatttcttccataccgccgccagtgatcttgaagtagactttctgttccttcatttgatggaaccagtccgagttctcgatcttctcgatgacctgcctcagggcggcgaactgtgtcttaccgccaccgctgacagtgaaatactcgaagcccttttcagttggaatttccatgcaagcttctgcatggaagctctgccgactgaacgaatagacgttgaagtgcagagggagaatcaggaaagcatcttcaggctgaggccaagactttttctgacgacgacgtcgcttgagcgcgtactccagctgtttccccttgtctgcaccgcgtggttgagccagaacacgactacgaacacggtacgtcttttcttccgtcatttctgcattccttggttggtctaacccacactcacatattagtttctttctgtatgcaggacaaccttaggaatcagacacttacgtatctgtttggaaccaagaatcagacacttactggcctatcacacaagaacccctatttctaggggtctcgtgcccaaccaccacaaggagttcttgttacaggaaacggtcgtaccagcggctcttttcgtaccgctcgaatggtcgaatgacgaacatatcgaggagtagagcgaacacgctgcctacaagccctacagccaggagaattgcgagaatagccatgatcaactccgcttgaagttttcagattttaacaggcgacgtgcttcctgtatagcctttcgacgacgcgtttcccacatgccataggcaggaccgaaatcacagttctcagcatcaaactctagcgcctcaacgagttcatcaatgaggcgcagggttttgtactcagtcgttgtcgaagccgaagacttttccataggtctgctcgaaagcgtccttttcttgaacttcggtctcgaaggtctgacgatgataggtacggctcatctgtcggatcagcttcttcggaatgtcgatctcttccgccaggttgtcgatgtgagccttgatggtcgagcgcgatgcttcgatcatggtcatcacattgctaatgtcctgacagacacccttcaccttggccaggatcttcggatcgttcagaacggggtactcgacagcattattagcagcattggtcacaggcgttacctttctttttggtgaaaaaattgattagcatttcccaagccgtaggctccttatcgaactctacgcatgggactagtctacacagctgatctcggaaactgtcagccttttcatctagtaccgaaacctcaaaccgaatgaggtcagtaccttcttcgatgttccactgcgaagcatgggtcaccatgatcccgtagaaggcaccgaagtgtgtacggttgaccgtaccgttgaaaatcttaaacatggttgcgcctgttctctatgttgtcgagtctaattgcctgggcaagccagagcaatgcttggtgggtacgccaattccgacctccaccgatataggtacgacaacgcagcgaaggcatgaactcaggttgaaactctggatactcttcccagtcttgcatcatcaaatgcacatcgccatcaccggcggtgtaaaccttcaaccaattcgcgccactgcgacccttgtcgtcacagtcgagttgatagatctgttcctgctcaagaccatctggccacttggcagcaaacggctcatcaagataatcccgacgagcatgttctatctcaagcgcgatttgtttggttgggttcatcagatgattctcagaatcgtagcgatatcgacttcggaatggacaatggaagcaatgtctcgcacgctgtacccttggtcagcatacttgtcgacgatcggtttgatcgcctcaaagacttcctcagaaagggcaagtgcctcagtcgtgtatcgctcgttttcgggattgaagaggtgcttaaccattaggtagttcttcccattctgtttccgggatacggaagacatggtgtttggagaaatggaatcggaagatgacattaccacctgcacgactcaactcgtatgccatgcaattacgaagatgcttctttgacttcgcagaagcctgccaatcattcttatccatcagcgaaatgccttttcatgttttcaaggaaggcgcgaatgttctctgcgcctacaggattctgagaatgaatgctgtaggtgaagtgctttgcgtcccacggttgatcgtagaatcgttctgccagatactcagcgcatttcttaccgttgtagtaatcatcgccgagatcatgatcaaaggcaacgtgcctcggaatgcccagctcttcgattatctctacgaactcccagtagttgcgagccacctcagcattttcaagagacccagctgggtcacgctcgtcatcgaggaacagatcgtaattagcgagcgccacaggaagcctccgacaaaagagacttgccggcagacgtccttgcgctgatcacagtcatctcaccacggcgaacgccacccgacggcttcaatatgtcgaggtaatcgaggacacggataccgcccttaaggtccggttcccaacggggcggagccttggcagtgatgatggtcacatccatctttccagcgaagtcgcgaagttgcttgtagatatcttgagtcactgtctaaccttcatcttgttccattcaggatacaggcttttcagttcgtcctgttctttttgcagggaatcttttataggattcttgatgccagaggcgagttctgcaatagtgatatgcgtgagctcactttctaatttctgaatcctcagccttgcctgagacagggtcatgctcgtttcagatagtctgcatggacgagaccgtcaactttgacgtcgctatcaatggcctcaagctggatgtgcgtaccttcaacgatacgcacaaccttgaacttgatgcccttgtacttgtcgaagtgcggcgcgagggtatcgaagacgtaactacggaagtagacttccatacccatcccgatcaccggcggcggaccttgtggccatcatacaggaaggtatcgtcgacgatggcgtcagcgatcttgttcagctcttcgagagtgatcagctcactccccgaacgaccgctgatcgcattggtacacatgctggtcagaccgctcttctcgaggcgataacgtgccgaggtgcatgcctgattgacggtgtacttcttgacagtgcgttcgctgtgggtgtaggacaagctcacttcggtgttcctttagttgatgtgttcacagtttaaacgatgacaaagaaagaacaatcttagatggcgaacgggaaaggactcaaagtttcgcggagagtcagcaggtcgccagaaagttcttcgataggatggctgtagtaagccgtcggaactacgacgcctacagcagttgcacagtttcgcatcgcaccttcacggaatagagcgaacggcatttgcagacctttcgcgggcggtgcaatcttttcgtacagctcttcgatactttcgtcaccgccgaaagtgcgcagcagcatgatggtcttgtggttgcgagcccagtcagaaagattcgacaggtaggcacgattccacttcgggttcaagaacttttcgtacagctcggggatgacgtgcatcccctgaatgcctgcctggacactcatgctatagcggtttacaatcagatacagtctcattttaatccttccagggcggaccatcgtccggtgcgccgcctgcagcaagattgaagatctcaaccatgcgataggcgtccattgcagcgtcatgcagtgcgtcgtgcttcaagaagtttcttgggaagccacctgctggttcgtactgtccgttttctgagccagtcagaacgtcaatcatcgtgcgcgtgtcacgaatcttccaggtgttgaatccgcacttcactccagcctgaagatacatgtgttcgatcttcgggaagtcaaagtatgtacctctcgaccagacaaatgaatctttccagcgataccccgaacgcttgatccagtcgttgagcattgtcagaccagaagccatgtcaacgtcttcttccgacggcttgaggatcttctgtgctgcaggttcctgagtcttccaccaatcaatggtgctctggtcagtggtgcgcttgtaattgacaatctgttccttgacactgaacttcacatggaagccatcacggatcagcttgtcgtagtcattcttcacacctggcaccagctggaatgctgctacaccgatggacagaacaaccgtgttttcgcgcataccgagggtttcggtatcaatggatagatgaaatggtgcgtcgctcatgcaggtctctcataggatgtgcgtatagtataatagctgaacccttccgagcccagctattattggtagtagatcagttcatcagatcgaagaacaacttggcttcatctggcttgttgaacaaccacttagccgtgtcgtcaatcgagatcatcactggctcaatgtctagcgaatgttcgatagaaacgatcgtaccgccgtcccacgatggttctgtgtagacgtttcgctttgtcttgaactcgctgacttcgcaagtttccgtcatcgacttgggcaacgaatcacccatgaaccagaacttcgatgttgcctttgtttccacagttttctccatcatgaattcttcaaacgagctgcctaccgattcgttcaacttggtgttgtgctttgctgccattgccttcaccacgttgaggcttacaagctcaatgtagtatgccttgtagatgcgaagttggttttcaggatcaaacactgcccattccggagaacggatcgagtctcgacccagaccagcagaacgataatccttaggattcttacccagttcggcttccatctcgaagatgtaaccacgggtgccatagctacgcgtgatgccaccacccttgtcaccaacgtactgctgtgccttgtcgatgacattggagaagtagataccgttaccaagcatacgaccaacagctgaggagtcgtttgcagggatgatctggaatccgttacgcagaaccatcgaagcagcaatcgtgcctgttccgtggaacacaggatcaagcgtaccatcctgaggatttttctttcggaaggcagcaattctttcagccgagcctgggaatgcaacgttgaacgacttgagcaccttgaatgcaacttcgccgtgcttgttgttgcggtacttgttcaaacgaatggtctcgagttcaagcgcagtctcatcctgtttcacttcggagaccttgaggtccacaagtgccttgccgatcgaagccttagccgccttgtcgatatcgccgatggtctggacgatgtttcggttagacgtgactcgaatagccaggttgttgtacttcaagatcgtacgaatacgagcatggtcaagcgggaagtcaggcttgataggatgcttgtagaggtcgtccttgattgcctcgacgtaagccatctcgccctgcatctttacgatcagagtacgagtggttcgcggcaggtcagcaaagattttgtctgcaaggtccttgtctgcgtcatagacgtcgagcagaacatcagcaaagttcttgttaagcgagtcacgatgcgacttgtcgcggatggtatgaacaccgttgacttccattgcaggagcaaatttacgaacaagctccttcttggcatcaatcgtaatgtcatccgaatctgcgacctgcatcaactgagccgcccaacctgtggtcgaattaatcaggttttccttgattgcatctagtccttgtcccttgaggcaattgatgtagagttccgaatactcggaagtgtccatcatgccacgaagcgaagctgtcgcgtgcgggctattctcagcacccttctttttctgggaaatccatgccttccagagttctggattgtaagcctggaacagcttgatagtgctatcgctgtagttctgtttgattgtagaaaccaaccacttagacacggtttcgagagcttcatcatagtgaggatcactcggctcgacgaaccaagcagttcctagaacacctacagtacgtgaatctgctgtctcccaaggcctacggtcaggctcatccttcatgatctttgctcttgcccaacgagcagccttcaccgcatcttcgacattaccgtgcaccgaaattgcgtgaacaaacgaagccagagcgtctcggctgatataaggcataacaacaggatcaaacttgtgatctaccaatgacgcgaaagtcgtgccgccatgaccaatctctccagaacgcttgaagacttcttccttgagttcagggaattgagcaatgatggtcttgaagagtgagctatccttgccgtaatagatcaaccatggaacaacatgacgtgccgctgtggtgtgtcctttttcaagcagatacttgaaatagttaggagcctgtgggaaaggatactcgccatactggttaggtgtcccagtcattggccagttcaaaggttcagccgctgccatcttctcatacagccaaggcatgatagctgatgctgtagtgcgggagtttgcattcatgtagaatgccgcctgctggaaagccttgaagataaggaacaggtcttcctggctcttgatcaccggtgtgatatcaaacttgccagccatcgcttcgcctagcactgaaacaaagtgatcagacatcgcataggatgcgccctgagtgaccttcttggctactgtaagaagatcaaggatctccatcgcatcaccttcgaatttcttcagagcgatatcgacgtcaccgatcttgttcacagcatcgacaagcttcttgacctttgcggaagccttgttatcgaaggactccttgtcaactgcaaggttcctaccaatggtgcgaccagttctgatatccagacgagcaaatgaagcctcgacgtttcgtaggatgccgtccagagtagacataggcatcatcaggcactgaatcagattacgaatcatctctgtttccgcagaagcacttagccacaggtgcttgcctgcatcatagatgataggctggagacctgcactggtaatctgtgtcaagtgatcaagaatgaaatctacaccgtcactatcgaacagatacgacacagcagttgtcactggatcattgccaaagctgccaccgaaggcattctgcttcaaagtcgaagcattgttgtaatcgatcagaagattgaatacagcatcggcatcctttctctgacccgacttcaacagggtgttgtagataggaccgttgatctgagatggcatcacaccgttagcaagaagcatacgcgcaaaggtgctctgcgtgtattcgttctgttcaattcgaccatgagacttcttaagctcatcaacctcgaatgtcttgagggcgcccagaaccttaggcaggttcgccttgatgatgttcgactcttctcccttaggccaatgatacttcatcatcagagaatggagcttaggatcaaaaccgttgaggtacatctcagagatggactcgttggtcacaatcggttcttgacgattcgcaacgacagtctgaattacagcagcaggcgttggagccttaggtgcagtattcgatacctgagttgctacagcaattgcgccagcctgacgatccttatcattgaggatcttgagcacagctgccgaagccgacggatccttcttacgaatccactggacaaacggatgctgctcccaaggcacatgatagccatgagacagaacaaattctggagatgcgacagccttcttgaaacgatcaacgtcaaagtgacccttgaagccgaaacgttcaaggtagctgtgaataccaccctttagcttgaacacatggagaagagcagccatgtattccgaatcggaaccgtgtgctgcaccctgaggtggcaacgaaccacgctgcccctttgctggcggcttggacatagcagccgcaacaggcgcaggagtcgttgcagttccagatgcccactggtgtttcaggaatgcggaagaatatccacccagagtaatctgttcacggaattccttagccacagtcgcaagctctggacgtgctgacagcttccaaagcttgacggttgtcgtttccagctgatcctttgcatcaacaaagtcttgaacagcttgatagacacgaggcgatggcttgttggtgattacacggcaagccttgatgatatcgcgaattggatcgtccttgatgtcagcagaacgaatctttccgctcttgacaagtgcaaggaacttcgttgccatgttggcagcgaccatgttgatgatacctgcatcatgtgccagcttgatagcaaggctccaatcagcattggtgtcagtcatattggatagctgtagcttacccagtgacttgatgtaggtcatcagagttgcagcatccttgatcttaaggagaccagcaaacccaaggaaattgatatagaaaatatcggctacgcgttgcttatccgtcagcaacgtagcgagaccagattggtccgtgtaaaagctgttctcttgtaggatcatattcttgtcagctaaaaataaaggacgacatgtgccgtcctttatttaatcaaacgttggtttcgagattagttatcgaaaccttccaggagtgccgcgtactgcgacaggtcatccgtttcacttgccggtgccgaaggctcctgacgagttgccggacgtgccggttctgcgaactcacgttccacagcctgtgcctggctcgttgcctgcgatgcaggacgtccacccggtgcgttacccagaaccgcctgtagacgggtcttgagctgatcgtacgacttgaacttctctggagcaacttctgcctgcaggctgtactgcttgttccacagagcttccagagctgcatcgtcgccaccgaacagcggtgccggtgccgcaaagcccgacttatcgtacgagcgctgcttgttggagccgttgtatgccttcaggttgaagtcagcaccatcccagaagtcgaacggattgaacggcttctcgtcctcgaacttcggctgcagagcagcttcgatcatttcgaagatcttcgaaccgtatgcaaacaggaagaccttgccttcgttctgcgggttcttcgaatccttgatgaccagaatgttcgagatgtacttcaggttacgcttctgcttacgagcgagttccttgttcgcctcaatgcccgagttccacagttcggaattgacttccatgaccgggtcggcttcgttgatggtcgaacggcagttctcgatgtaccacttgccggtcttgtcgttcttgaatgcgtgagaatacatcttcacgaatggatattcctcacccactggtgcggtcaggaatcggatcacggcgtaaccattaccagcttcatcggtcgtgagcttccaatagcgctcatctggaccattaccaccgccgcccttcttctcgtcagcaagcttcttgctgaggtcggcgaaattaccacgctgcttcttaagtgctgcaaatgacatctttagtctccgttttctctatttgaatgaggtcttactgtctcttatggacttactttgcctctacaagtctgttgagttgttgcttcaggaaatccccatccacttcaatccaactactgtatttactcaacatgaatttccgttcttcccagagagggtccaacgtgtcctgtgagcaatacttgaacgccctttctaacagcgcgagcgtttcatcggtcacaccaccaataatgtccgactggtgtgatacaatatacggactttgaccgtccgacaaaaggagtttacgaacatctatcttattctcctccatgaacatcacaagacgctcaatgtcggttcggacaacgtacttcaaagaattgattacagccattcgcttcttgtgatactcgacattctcttcctcgagaatctctccaatccaagaatcacgcttacgcttgaacattgagatcagcatttgaatgatcttctctcgatcatgctgttctgcgagctgcatgaagtaatacgcgtcctttctctttagaagttgctcctcacgaagtgagagcaccatgtgacgcttccaaattagatcaccgttgaagtgtagcttgagacctacataatcttggaatgttctaagtggtgcgcttagaaaagtgttctggacggtttctgaatgcatcgtctgattttacgttcacgtgctgcgtcttctttcagacgctggatgatgacaggatctaacgtactaacaaactcgtcttgctctaagtcgtgttcctcacagtaatctgaggcggcctcgaacaatccaatgttgtctctttttgaccgaagcatcaactcttcaaggatcttttcactgtagctcatttaggtgcttctcattgtgcaatgtttgcatagtaattcttgactcgacccaagaccatcggaacaaacggcttgatgtctcgtaccacgatctgcgggaatggcgaatcgcgtcgagcaatgaacaatgccatctgcttgatcttaaggccaagcatatcatacagcatcatcgagtaggcagtacactggaggtagtagtcctcgaggtattcctctcgcttctccttcttggagttcttgcagtcaatgagagtcagcacattgtcgtacagacccagacagtccaaataacccatcatcttcatgtggtcagaccagaccttcatctggaccgcaattggctgcgtacgcttcaagtagggcttcaactgtccatacagtctatagcctacatcattctcataaagggattcttcaaacggtacctcattgatgaccgactcaagcgaatcattgaagatcttatcgagtgaggaaccaattgccttagactcagcgacgatacggtccgcttcttcatgtccaacacgctcacgccaagcatcaaggccagtcatatctttggtgccactgaggacacgcgtcacacccggatatctatcgagtggtttgttaccatccgccttgaactcttggacgagtttacgtagttggattagatcagtcatagagtgaatcaccaattgttgagaaaccccaagtcacatcggggtcagggacctttttaatctttcctgtgatgagctttacttcctcaggagactcctttggtttttcatcgccatacaaagattcaagcatatcagcataatcttcaatactggccatgaactgaatgcgctcttgcatttctgctaaattgttctcgcgtttatagaaccccttggttgcttctataaacttttcaaggtgctgatttgctcgtggcgaagggccacccatcaaacttgccacagacttagccatgattaatgatctttgatagtactacctggatgtgctttcttaacctgagacaagaagtcgcggaattccgccggagccttgtgtcgtccaagcgcctccggcgtaatagccgcccaagtcgtagcggtgaaggtctttacagacactccaccacattctttgcatacggcttcttcgcctgactccatccgagcaatagacatgatctcagtttgaacatggtcacacgtcttacatttgaagtcgtacattggcatcttagaagccgccttccttaaggatcttggtgagtttcattgtcgtcaggtacccaaacatcttacccgtcgccggagtcgcagcctcataggcttcaacaattttagtggttaggtcggcaggaatacaccgaaggtcgatcaacttcctatttcggtggaagcgatcaagtgctgccgaatcaggacagaagtactctggattgttgatgccgtgcttcttccactctgcgagcttgtctttacgaagtggcttctggcgcttcttcggctcagccaggaaggtatcgtcatcactcagaatgttcggtacaccatcacctgcgtcaccctgacagatatgctcaaacagatcatactcagcattcttcggagtgaggaacttcttatgccaaggcgaccactgcttgattgcagaattctgatgctgcaactggatcatatcgccgtcggacgtcaccagacagaccggagtgtgaggagcataacgaggaccaagtacgcccatcaaatcgtcagcctcagcaccgtcaacctccagacacttcacagggaagtaatcacgaagctcttgcttgaactgatcgtacattgggaagaacgaagtccaatcgaatgtggacttgtcacgaccttccttgcgcttacccttgtagtaagggaagatgtccttacgccaataatggcgagagtcgaaagccagaacaatctccggtccgaaatccttacctagttttgctttatgcgacctcatcttgtcgatacacagattgcgtacgacgtgcatgtcgacctgttcattggtcttagcatggaagtcgagaacctggctaaagaccagattgctcatatcaattacgatcatgattaatccattcgttgattacgtttgcgatgaatctcacgagagtctagttcatactcgtcccaatcttcatccacatcatgcgcccgccggaggagatctttcgacctcctctcggcacggcgatctttactagaagcgaagtggtcggagtgaaactcgtcacgacggttcttgctgctcatatgttacgacttccgcttagccttgcgcttggcaatacgagcacgtccacggagggcgcgagcagtattgtgcttactcttacgagcgattgcctgacgaaccagatcacgatacagtgcctgagcatacaggtttgctgcactcgtagtgccttcggacagatcggtatcggacagcgaggtcattacatcatcagtgataatcatttcatttctcaggttgggttgttcttgattgcgtcatcttcggctgcgatgatccatgccttgaccaaaccgcttcttacgatgtcttcgatgccaaactcatggcgaatgaagaactttccgcaagcacctgcgattcgaacaaacctatggaatccactcttaccaggagtcaaatcggtctgacgagtgtcaccacagaagatgattctggagtcattacctagacgcgttactactgtatcaagttctgcgaatgaggcgttctgaaactcatctacaatgatacaggttttgtcatatgtcacacccctttcaaaggaagtagatccaaaactaacggcgcccttcagcttgagacattcgtaggcatcagcacgcttcaagatcttgttgaagtttgacttgatggctctttcgtagacttcgagtttctgtgcttcggtaccaggtaggtgaccaatttctcgcgaagaaactgcggagcggatgatgtgaatgtgtcggacctctcctgccatcatggcttggagtgctagggcgagcgcaagatacgtcttacctgtgcctgcataaccggtcaggacaagattctttcctgcttcccagtcaaggcgtgcttcggcttgggtacctgatccctttgcttcgaggttgaagttgtcgaagagtggatcatgctgcgatgtctttggcgacttgtgaggtttacgtgccattattttctcttgagtggacgtctaactttcgtgagctcgagcttggcattgagcccagagaaagtccgtttctcaagatatttctgtaggtctggaatacttgttccatgttgtacctgggcgttgatgtctttagcaacgaactgcggatcgaacatgatgaccttaatgccttgattgaccgctttgaggaattgcccatacacctctggatttgtctgatagtctttgtcgaagatcaagacaaggtcttttttagcatgttctcgcaggtatttaatttcagacatgatacttgcgcctgcgactgcgatacagttctcaacaaacatcgcatcgaacggtccttcgcagacgtagaccttcttgctccagtctaccctgtcaaggccccacagcttctttgcagatggatcaatctggagcgtgatatacctgatcgaaacgtcaccaaagaaacgagcctgcatgtagaccagttctttcgcctcattgtagaacggaatgaggatacaatcactcttgggaagctgtctctccttatagtcgtctagttgattcgtaatctgagtgatgtcttcgcaatagtagagatcattccagaacttctccggaatcaatcgtcccttgatgtattcttttgccttgtgatcatttggaagctctgcgatgctgagacagccatgaagcaatgtcttgtctgcaaacttcggctttgagatgaacttctcaaaaggatcagtctcgaatgccttgactcccttgaatttctcaaaggtgtactctttcgccaataccggagctacctctttcaggaacgaatacaaccccatcgacgcgccacagttgtgacacttgaaattcgcattgccttcgatctgatagaaatagccgcgcgtcttcgactccgacttctgcgagtcaccacagaacggacaacgaaaacgagacaaggttgcacttacctctttccacccaggtaaataacttgacacgagcctcgtgtatttcaaatctagatagttcatgtgatctattttaatgcggtgccgtgcattcgtccaattaaaggtgaaacaagatggtagatagaactaaagaagtcgtgaagggtgcagttgctactcacctcggttgggtcaatccgaagactggcgagctcgtcgtgtctattcgtggactgcccgacgcagtggtttggtcaaagcgcacgcattctctggaagatttgcaagatatgatcgcgccggcaggaattcgtgaactgagcgaagatgagattgccgctatcaaggaagatgcatttggtgaagaattctcggaacgtaaagtctttagcgtagacgtgggtgaccttactacagaagaagctacgaaggtagtcgagaaggttattgaagacgtcaaggctgctgaggttcctgccaaggcaacaaagaagaccacgaagaagaccaccaataagaaggctgccgagtaaggttcccagatgagtgatgtgaaagacttggcgaaagaaatcgccttagacggttatggtaaaggcgtcttccatgccaagacattcgacaaagactttgctgtcttcatgaccacaaggaagatgatcgaccggtttctaaagaccggtcagatcaatgaaaaacttctgatcaacaatatggttgtgactttgaatgtcttcggaccaaagaaggtgacagctatttgtcgtgtgttgctgaatgatgttcaattcagtgtcgcaaaagctatactcatgttcttgcatcaatatgattggtcgattggcgccgacgtctggccaaatcgaattgttgtcgatatcctaaaggacgtcactaatcgttacaatctgggacacctctaatgctaagtaaactcgcattgaacacccagacattcctttggggcatcggcatcgcacttgtactaggtattggtggcggcgccggctcaatttggtatgtcaagggtctgcaaattgatgccattcaagctacgcacaaagccgaggttgccgaaatggcgaccaaagtggctacggctgaaggcgcatccgccaatctcaaattgacatttgaaaccagtctcaaggacaaaaagaatgaactcgaccaagcctacgttgcgcgcactgcttctctcgatgctgctgtgtctaagcttgctggtatccgcctgcgcgacccatcagcaagtggtaattccggatccaccagtggtcaaggaagcaccagcggcagtaacggatccaacgccaacacaggagaactactttctccacaaactagccaatttctttggagtttcgcaggagagtctcaactctatcttgaccgactcaaccaatgcaaagcctggaacgccgaattgacgtcccagtctcagaagtactatgatgagattcaagagctcaagaagaagctcaagaagtcctaatctgcgatagcacgtaggagcgcaccggagaatccggattgcgtacaatgacaggagttgccgaagccgttgttcttggagcagcggcttccttttgcccgttttgaacgacctgggtcggcgcgctgattacaacaggagcggttcgggctgcctgattctgcttcgcagcttcgcgtaccattggtgtaggcgaagtcgaggatgccatcagattgcctgacttctgagccgcttcaaggaatccaagtgagctatgacctgcatggttgaagcctgcagcattatacatgcctgcgccaccagatgttttctgggaagcccattgcgatgcgatatagtcttggaacttagcagctgagattcgaccagacttgaacttgtcaaggttgccaccctgattgagcagcgtcagtgcaagcttatcctgattctcagtattgaacagatcatcttccttgaagcctgccgcagccatctgcgccttgagtgtgccactaatgaactggtagcgtcccactgccgaactacgacggtttgcaggaataccgcggctcttctgttcattgagcgtatcacgctgccactgcatcacttcgccgaatgtcatctgagatacaggcttggttggcttgacacgagaaccactccataccgaatcgtatccttccttacccgcctcacctgctgcaatctgattgagaagatcgcgctcaaagtttcctgttggaccaacagtgacacgaccacctgccattgtctgaccggaagttacagaagtgccttcacccatcgtgcgaccagctgtcacaggaccaatgctacccggagcagagtcatatggacttgcactctggattggctcatacttggtgcctgttggaacaccctgcggattataaggtccgcgagtctgaagagttgatgcaccaacctcagcaggaacgatatagatgcccttggagcgatcgctcatcaagtcgagcatcttcgccatagtgacctgcatagagtcagtcgctgcagcggttttgcgttgcgctaccactggagcagctgcaattgcagccgtatgcaccggaggcttaggcgcagtagctggcttggctgctgcggttacagcaggtgtcgagctaccgtcattcttaaggtcacgtgcaaggatggcagcgtcaagtccaagacttgctgctgtaccaatgcccggaatagttcctgcaagaccagatgctgcttcgaggcctgcacctgtccagtcaccagcgtatgctcggtttgctgccaaaccaagaccggcgattgcaccaatgataggaatcttcttgagtagagacttgcctgccgtctttgctacacccttaccgatcgctcctgctgctgatccagcaatctttgctccgcctgcgccagcagctgctgcaccagccttagccaagattccctttggagcaacctcagctgcctgcacagcgctacgtgcaatgaaacgaccagtcttaggatctcgaagagcatggcgccctacgcctacagctgctctagccgcagttccttctgccgcaataccagcacgagcaaccgttgtcgcagcttcacctgccttacccatacctgtgatagaacccatgaggcgaccaacacctggaattctagatgcaaatctaccaacaacgccgcctagcttggcagcaggtccagtgataagggatggcaatagagcaggaaggcttgtgatggtcttgagcagcttgtccatcattccgccgccaccttcgccaccgccgatgccgttcttagcaagagcctcgacagcatcacgaacgcgtacggtgtcctttgcaatgacctttagaaggcttgcattctcttcctgtacaccgagtgattccttctcagctttgtcttgacgttcctgattgcgagcagcatcatcgcgagccttgtcacgattcttcgaagagctcgaggtagactcgccgcgctctttctttttcttgtcgccggtggatggaaccttgctgagatagctaccaatcttgtccagcgccggtactttggaagcaccagaacttcttgcgagtccttgaactagcttgttgcctgctaccttattgagtctcgaagcaacgatgaggcggttgccagcagcaccaaccgcctcagaacgcatcaatgaagaaccaattgttcttagaagtgctgggagcattttaccttaacctgtttgattcaacttattcttttgtgtttgaactgcaatcaaagaggtcatttcgatctcaaacaacggcatatcgtccagttcatccagacgatagccatgttccgttactagtaggtgcctcagttcaagcatgtctactagcttgttagttggatagattacaggaaaaaatcgtcgagcccttggagctcgaaaccatccttcctgccgcacttagggcaggtcacgtccacgttaagagcgaggacaggaacgccttcgaagaatgcggtgatctcatcaagtgccgaagtcggaagttcgttgagccacttcgtcatttcgtcgaagttgaaatcggagccagggacagacatgtcttcgccgtccaagatgtactcaattcctgagaagatatactgatcggagattccaatcacatccttgtccaggtcgagtttcttgaagctggcaaagtcaggcatcttcagcttgatagacatctgatcgtcgatctggattagctttgaagattcatatccttctggatatttaatctgggcattctcgagattgaggatcagttcatgcttggagccacaaggaacagtctttgtgacgatttccttcttgccttcctcgacttcaacttcctcttctacttcaattgtgccaccacagctgtactcagcctttgagcgagcaccggacgacttgatgaaggagtgtaggaagatgtagtcgataagatgcataggcgtcttagcaagatcaagctcgccaaacgtgatgccatcaatgatgtctacgatagtgttgatgatcgcagctgcatctttcagttcaaggacagttagcaggttcttctgctcaccgacctttaaggcgcgatacgagatcgtctttttgagctctggaatctccagagaaaatctaattgctttgggtgttcgaagcgccattcacatcactcgttaattgtctttgtttcaacataggatttgcccttgaggaacttcaacaggtcatcgcaatccatgccaatgactctcgattgaatcttcttcccgaactttgctgccgccaaccaacgatgatgaccatctacgacatagccgtcggcacttgtaattataggcttcgcttcccatttagcactggagatcaggtagtctaccttctcctcattgaagttgctttgcgtaggcttcaacttccatggactgagagattgaacgtccgtgctaatgtcgttgtctttcaggtctgccatgaacgcatcaaattgcgtgagctgcggcataccatgacgcattttccctttgccatccttggcgttgggaacctttagatcttcgtacaaccatgtatcgaaatcaatcatcgaccttttgtcctgtcttttcatcgacggagtgggaagacttccacttcatcggacctggctttggatacagagtagtgatgtaccacttcttttcattcgggtcccacttgaaacccttagcctttgcctcatccttttcggagaatggaacagagtagtaatgcttgtaggtcttgcggtttgccgcagctgttctacgagcctcttcccactgtcgcttcttttcacgttcgtctgcaacgtgatttcgataggcctgtttttgcttggattgcatctcacgctgagttacaaagccgccacctgccgctgcttccttcgcacgcttgtcagactcagcacgatgcgttacagcagctgctctatgcttttctgcttcttcggcgttgccttcgtactcgtgatgcttgaccatggtatcatggtactttgccatctccgagtggtgacgagtgtaatcagcgccatgcttagctgccatagcatccttttgatgccattcggcttgcttgttgtactgaggatgcttctctaccacaacgatcttggcacggttagacatgtaggtcttttccttgccatcctcgtatttgatagtgactttccaatgggttccaggctgaccatcttggcttgtcgtgctgacaaccgcagtaattcgacctggcttaccgtttagctttaccttgtcgcccaagccaaattgcttaggcgccttcgcttccagcagagattctaccagcttcttaccagcctgtgagacagccgcattgatttcctttgcgaactctccttctcccttccgcttctgtggcttctcgggtggcatgacgttgtctggattcgccacacctgcagttacgttggcgccttcgctcatcttaggcttccggtggcttaggcagagtgtcgcccttgtcgtcgccaggcgcagccttgtccgacttctcaatcacttccggagtggtcgagcctttgtccgaaacaacaggcttcaagtcacagccttcgccgtcgccattcttcttttgatgattcgcatccgagattgcctttgcatcttctgccaggaagtcttcgaacgacggaatagttactgtcaagtcaaccattttctaacctctttttcattgttgagtactgatcccagattgctctagggacattggccttaaaggcttttctatcgccagaccggatggcctcacgaacaacggaagcagatgtcacacgctccgtttcaacgaacctgacaagacacggctcatcaagctctttgttggcgcgttccatctgcgccttgtactgaccaatgcgatcggaaccgcagtagacagcatcaggacaatcaccaagcatcttgataatgtccgggagatacccagtctctgactggaacaccctaacacctggcttcaccgtctctagaagtttcttttgataggcgaagtcgaaagggttcttctccgtgtccttcgatgacacctttcctttgacgatgacaacaacagggttgttcatcctctcaagaacagcaaggtgtccattgtgaaccggctggaaccttccgaagaacaagtcaaaattagccacccatcactcccttgaaatagatcaaatcgcggaagtagtctgtgacaattttgtactcagtcttatttacggtgacaacaacgccttcgaaattcttacccatcttgtgctgctcttctgcctgcttcaagacatagtaacagaactgatctttgagtgttgcaatcagggccttcattccaagtttggtttctctatctacctgacggcgcgagtccaagatgggcagaagttttcctgactgggtgatgccattgactccgctcttgaaataactctgcgcaggaaagtctaccttgaaacgagtaccaaaagtcttgatgttgtcatcgaatcgaaggtcgccgtagtagccaccaatccaggtcagaccagtagacgcctcaatcaacctatagattgctagagtgatatctgtcttgaagaagtctgcatcgtaaggaatgttcacgaatgtgcgagtgttgttctctgtgttgagaacagacattgacttgtcgaacacttcacactcaaagccagagtcctccggaagatggtgcatgatatccgaattccaaatcgtcttgatgagatggaagtagacctccgctcggctcatgcccgtgtggtcatatcctttctcaagcgaatgccagatgatctccatcggatcatagaggacaggagaacgcgctgtctggaaccaaggcttgttctctttgtcctttccgaacctcagaaagaatccatcgagcttccaactcaaatcaatctggtcaccctcgaatttgaggatccattcacagaactctctgtcattcatttcacggaagtgcttcatgttcttccgcttctttgtctctactgtcatagctgtctcaccgttgccttaggtggcactctatcatcaattacgaatcgggctgctgcaaagtcgcccaagcctgttgtgaagatacaaggaagtccatgggaattgagcttggtgaagttgatgcgaaccatgttggcatgaacgtctctcttcctcagtcgtagatagtaaggcttcttcttagcatactccgcgacagtccagaacttgccgttgaattcctcaccattgtagtcaacctgatcaggaccaacgtagatgaaatcaatcttgccacctacctcatccgaacctgcgaacatcttgtatgcgtagatttccggaataccatacatcacagtcgggatgttacgaatatcgtacaccttcccttcttcgaagcccatttcgtataggtcaacctgtacctgatagtaaagcttggtcactaactcaggcaccgacttctgcaaacctgcaatgccacctgagccgagatcggcagcatgtgacatcttacaactcacattatacgaataattgtgttcgtcccaaaccacaacatcaacgaggttctcttttccgtgtggtccaatgtcaggcgcctgttcggctcgcttgattcggaaattctctagcttgattggctgattccacttgttgatgacgtcaaccaaagatttctcttgccgctgctggaactccttgtctcgaacctcaggtgttcctttgagtgttgactttggaacgaacctagggtccttgaagaatctcgtaacaggcagccaattgtcctgcgtccatagtgccggcggtgtacctttgacagtcagacaatactgggtcagctcatcctcactctcagattgcttgtcgccaagcataagagcttcgaccacaaccttctcaccgtcgaccttcttaccaatcgtcatgacgtcctttgccaagacgatgttgataagaatagccgcgttgtttcgtttcaggaagtcaatcgtcttgaagaacgccatcaatacgtctcatagtaattccctactcccagatagggctctaccttcagaccaagggtctcaactagcttcaggtaagcatgccccttctcgaagtagtctctcggagcattgtcacgatacagcctctgagaataaggaccccagagcagattgtgcataccatcagcaatcttctgatgatcttccttgtcgatccatgtgcgaatcaaacccaggacaccctgataagaatacatatcacaaatcgaatctgcgtcgggcttcaccttgaagaacagcttgaacaggtcacctacgttcctgatcagagcctcttcatccatcggaacttcttgccagacgtctggacgaatctctcgccacttgacccgagcgcctttcggactgaacacgatggggctgatctttttggtgacgaactttgtcttgagctggaccttagcttccctcaaccagatagcggtgatcgcccggaagatgtacttgtgagcaaaacccttgatgcctgcacgaacgtcttcccaagaactcgatcgactgaactgcgcccagttcgtgggacgattgtcggcgaattctacgagctcgaaatcgacctgatagtacaattcgatgtcttcatcataccaaagggtgacgattgtgtctaccgtgtgatgccaaccaatcagcttaaactcgctgacgaagtcctcatcttcgattttgctcaggagcgattgaagaatgccagatttttctacatcgacttggatgtcaatgtcaccataggacgatttgaacctgatcaattcttcagttggaatgaagtcatcaaagatgtgtcgagtcgaacctgcgaggtaaggaccaacgccgtcgctctcatcccagagttgcttgtgtgaacaacggttgagcgtgcgccacaggtgctcaatctttgccttccagaaatcacgaccatcctgacacccgatagacacagggcttgcagaaatgccgttgaaaatcgcgttaccgcccatgacgaatcacctctcttttatgtcgtccaattctagtggatcgagccagaacggcacagaatccttagattttgtaccgaagaatccttggtagctttaggttttctaacagaatcaggcacttacgtaggttgttcctggggaagaaatccgtataattgtggttgtcagatgtcaggcaaaaccactttaaggaacaagatcatgagtaccgcagcaacggcagcaatgaagcgagaactgaaggccaagtttggcgacaccgttacgacgggccaactcggtcagtacaatcgagagtatttgaagcgcgctcgacagggcgagctagagcaggttgctcgtggcctttgggcgatcacagcagccggtttggcacaggcgattgcatcggacgatgatgacgatgacgacagcgccgctgaggttccggagaagcccgttgatgctgcgatgattcgcaagcgcttcaacatgctcgagaagctcggcgaaggcatggtcaacggcaacattcgttcgttgatcgtgtcaggttcggcaggcgtcggtaagaccttcaccttggagcgccagttggaagaggctgagcgcaccaaaaagatcaagtcgtacgactcgaccaagggcacgatcagcgccgtcggtctgtacgagacgctctacaagaatcggaacaagggtcaggttcttctgctcgacgacgtggatcgtgtgttctacgacgaggaagcactgaacattctgaaggctgcgcttgacaccagcgcggttcggacgatcagctggtcgaaggcctccaagtacctcgcagacagcgatatcccgaaccgattccagtacgaaggtcagatcgtgttcatcaccaacctcgacctggatcgaatcgtcgccaagcaaggtcgactggctccgcacattctggctctcatgagtcggtcgatcttcctggacctgtgcatccataacccgaaggccatcatggttcgtgtcgagcaggtgctcaaggaatcgaacctgggtaaggacctcggcttggatcagaagcaggttgaccagtgcgtcaagtggatgaacgataacttgatgagcctgcggtcggtctcgatccgtacggtgaaccagctcgccggtttcatgaagacctctgccgctgactggaaggacatggcggacacgaccctgatcaagggcttctgatagtggactgacatctgacaatgcaggccactcgacaccctgggaaaccggggtgtcaccttgagtggtgtccggatcgagcctggcacaccccttagcagctctaggcttgtaagtgtctgattctattggtggttctgaacagggcttcccgtcaagaataccaatagaatcaggcagttactggatacgcttttaaaagctgagccagtctgacggtcataggactgcggtcggctcagattttaagctgtcagtgccggttcggcggacctggaattctctcgtagccaaagccttcggggtcgccaacacaggacaggagctcgcacttgcctgttccatgctgccacatgccgtagtaatagtcgtcaccgccgtgcaccagcccgaagaaggtgtaggtgtgttcacgatagcgatacagagccccaatgagaggctcgtattccttgattagttgattccagatgtctgccatcacacttcaaaccctgcgaattttccgccgccattagcgctttggaatttgtccttcagtgaattctggtctgtgacaatcttcgagtccatctgtgtgaactcacctgacctgtcatcgtccagtccatagagcgtttgatgttcaatcttcacaccgattgtgaacgtggtcttgattgacttgttcgcatatcgagatttcaactgcttgatcagaagttgattcacctgatccagttcatccgttcgaatcattgcccacataccgtcagccgtgtgagcaatacctgccgactctgcgatgccgctcatgtcaacgtctgtcgcgttcatctgaccacgattgaactgcgcagccgaccaaacaacggtgttggtctccacagccagagcacgaagctcttccgccaccgatttgaagaagtagtaggagccaaccgaataaggcagacgatacgatgcgagaatctgtaggtagtcgacgatgatcacatccgggatgaagttttgcttcatcttgagctcgtcgagcgtctgtcgaatgttcagggtcgatgccgaggtcggagggaattccttgaccttcagcttaccgtacgatttcgccttcagtgcatcaatgcgattgaggaacttctcctgaccaatgtcagtgatcttgttcatgtccatgccgaggatgttcgcgtccactcgctggaacacaacttcctctcgcatttcgcaagacacatagagcacgttcaggccatcgcgaatgtaatccgcagccaggctgaccagtgccagagacttaccaacgttggtacctgcaacgaacaggttcagagtcttgcgagtcagaccacccgaagtgatctcattgaacgtatcaattcggaacggaaccttcgactcaggattggtatagaagtcccatcgcagctgagcgtcatcaaagtagtcttgtccaacctgtgtgttgaacgtgacactgatcgcctttgcaaggatgtctggaatcgctgcaatcgagagctttgtgttctcaccctgatagactgcgatgccttcctgtagagcattgtagactgctcgttcctgacaccaggtctccgtgatcttcttcaaccaatcgaagttctggctagggataatgctgaaaatgtctgcaactgtttcaattactcgagcactacgaccctcatcaagactgcgatcgttctttgcctcgaccatcagagtcgatttgtcgggcatctcattgtacttgcctgcataggcattgatcatcttgaagacgcgcttctccgactcgtcctcaaagtattcttcctttacgaagggaagaatcttgcgcatgtactcttcattctttaccagcgccgagagaacaaggcgctcatttgttacttcactcattcggaatcctgctcaactagaccattaattctgacacgaccatgacctaattcataggtttcaccgttcttagattcaaaccaggttggatcccatggaccacgaatgcttagtgcccaggcgcctttaggatcggcatgaatcttgtggaagcagttcttcggcgtccactttggcttccaagaagggaaccaagacttgacacgaccatccttcatctcctcagttacggctcccttgagccaccaagtcaaagcattgaatgcgtgagaatggaaagcctcgcgactcttgccttcaaagtgaagcagaacgatcgagaacaaagacttgcactcaatcagccaatagccggtgacgccggaatctccgccaccatcatagctcttacgaaatagtttcaatttaatcctccttgtcttaggtcgacgatgaggaagtagaagcccataccaatgtagaaccactcgccatcggaatcaccgatgcctttgtcccaacaggtcggggcgaacgctaggcgccgccacttccaatgataccagttgccagacacagtccaacgattctcctcgttcatggtcttggccaacccatcacgttgtatttcaaatgatcacctgcaagagctgctgcatcgcagttctctttgtcaacgccgtaggtcgtgacgtgctcgtgggagccgaccttacgtccaataattatgatctggtcgaaaccatacttcttcgctacgtgctgcgccgctgagatcggaatctcgttcattcgacgacctcatgcccaagatgcttaaaaatttgcgcataaacgtaatcacgctcgaaattgtctccatcgtagcagtgagcaacaggaacaaattctagagctagctgcccatcaatgtagacgtttgctccgtcggcataactcccgccacaggtctcacagtcgtagctgtcgtaggtccactcgattctgatctgcattgtgatcttctccattcattacaatatttgccatactcagcgtgatagttgccccagtattggttagcgaccatccactcgtgatacgtcatcatcttgttcatatcttggcaatcctggcatacctaaatctgattgactcaattctctagattcggtcaatgcgaatatcagaagcgctccaagaatgaggaggtacattacgtacctaccccattgccccacaaatcattctgcacacggtgagagtacagccaaccttcatcaatgcatcgctttgcaatgccgcgcgcgattaccttctgctgttcgtcagtacaagcctgaggcatgatccagatcggaacagtgcgaggcagaccagcagcgtagtagatttccatcacttccttcacctcagcgtaatcagcctcagatccgtcaacgacgaacttgaaatactgattgacgcgtccagggaagttgtgcgtcagaacgtgctgcatcagagcaatctcagggcgaattgcctgcttacgatcctcaccactggacgagatcttcggagaattgctccatgtccaaatgcggcgagaatcttgtccaagccactcgaagatgttgctgatgaattcttccttgaacggaactgagcagttcgtctcaacgagatagtgacgtgcatctttcattcgaggatggaacagaatctcaggaatgaacttccatttcaaagtaggctcacctccagtcaaagagatgatctgaggcagaccagtgctgtagatgagcttaccctgaggaagaacctcgaacagagcatcaatcaatgcgtccgtgtcgtacttcttccacatgtgtgcgaagatcggattgactgcatactgactatcgcagcctttgtgaatcagcggaatatcttccagacgttgatagtccttcggatcgaaatcgagaggcgcgtagccctttgcatcaatcagcttctcagggttgttgaacaacggacaagagaagttgcatcgtgcaaaacgaatgtaggtagtcggatggaaggtgaattgtgcctcaccctccaacgagctgaagatttccgatacttcgaacagtgccattagccgaatacctcgccattgctgatgccatagattgcatgaacaccgcactcaccatcttccgaaacttcaacctcaagggttcggtagagtgcaggatacttcaatgcaacaatctttgcaatgtcgtctgcaatcatctcgcacgacttgtaatcaagaccgttgagtgccacagcctcttccaagaagttgaggaactggtggaactcgatctcacgatcgtcatggaagacctcaatggctaccttgaagtggaacaggtggcggtgagggtgtgcaaggtacgcgacgtcttcgagtccttgggtgccggctgctgggtagcggtgaaagcctgccttccggaatgttacccaaatctttttcatctaatggttctcctaaatggtccaactatgatatagcatccgtgacggtgaatcaacggatgctatgtctttaaccgaaaagctcttcgagactctgctgcttcgatcttaccctgtccgacttcaacacgttcttgaacgtcgagtgccagacattgaagtcagcgcgagtgtgacactcagcaagtcctgcgataggatgctggtgcgacttacgaatgcccttcatgtatccatctgcatccatgtactcttcaatctgagtgatgaagttatcgtacgaataacggaacagagcaatctttgtctttggaatgaatggtcgattgtgcgactcaccaatcgcttcaacagcagaatagctcgggcaagtgatgaaatacttgtagagagattctggatcatcgaagccgatgttgaacttgccaatgtgatccatcatgaactgataatcacgcgggcgataaccatccgactgcaacagacgagttccaacgtaggtgccgtcaggacgtcgtgtgtagaaacgcgaacgagcaagtccacctgtgtgagtggtgctatcgtagctgatgatcttgttcttgtagacgcccgacttagcgagtgccaaaacaggagcaagacgatcaaacgaaccaacacccaggaagtggatttgcttgcagtcaaaacggaaattcatctgcgaggcgacaaatgccgactcgaagttttctaggtctccaggaccaagcgtcgaggttgcgactgcgacgcctgcgatattgtccatgagctcatgagggatctgatcctggacgtactcaacccagtcataataggtctctggacaattgccttgagcaataagcataggcttagcgatcgtcccgacttccgcaaagtattcaagctgttcacgtagattctttcctgattcaattgccttagctttcagctgagagcgatcgaagaccttcttacgggtcgccgacattgcaccacgtccagcataaggatcgaagatctgcgagacagggatttcgtcgaacgacattgccacagtgctgtaatcagcctgagtcttgtagatcttgcgcttagctgcatcatcagcaaccttgccaagcgacaccatctgcagaccacctgagtcagcgtgaatgtcgcacattacgtcagcatagttctccttgaacaccttaccgaaggtcgattcagtgaacgcgttgaacagcataccgaatttgttaggtccacgatctgcaccaacgaacatgttgcgtacccaatcgatcgtttcatcattcactccgccatctcgacggagtgagttgatgtacatgaaagacgttccgcttgcgatgtagtggagttcgtttccgttgtagttatctgtcatatcatccttgggccatgatctgacccatgaagtcagcagccataaagtaagaatccaagaagtgctgcgcgttgagcagctggtcgcgctgcaggaatgcgatcaccttacttactgcttcgtcgttggtgtcgaacaggaactgatcgtatccatgaacaagctcaacgtgcgaaagacctcgagtcagtacaggcgccacgtcatacatgatagcctctacaatgcagtaaccgaagttttcctcgatagagtttgagatcatgacctttgcagtcttgagctcgttgtgatactctttctttgtcagcccttccttgatagtgatcagaccttgcttctcgtacatgcgagcgaggtcaaccaaccacttctgattcgagcggaaagtcggacgactggtcgtcagaacaatctcagtgtcaggcaatgcttccttgacaaggagtgcaaccagcaaactctgatccgggcgcttctcagagtcgaatcggttggtaatcacgatcttgttcttcttcggaccaatcgaagtcttgtcgtatgcgcttgggaagagaggattgccactcacatgaatcttcttctcaatatcacgacggtcagcttcgcttgcgaacgcgttcacacgacgttccatcactgccttcttatgatagtgcgagccgacaaagataccatcaactgccttcagccaacccagctcagtgtacttctgatagggcgccgcaacagcgaatgcatcttcagtggtgtaagatgccgcatgcaggaatccatagatcttgatttcgaccttgttgatctgtgccatcaggcgcagcgattcaatgccccagaattccaagtcactgacaaagaagaccgaaccattcggaatgctcttctcacggaacatacgagcaatcttctgcatctgagatgccttgtagaagatggtcgagttcatatccaggaatgcgccagtctcaaccgagtcggtcagagtctcgccgtcaatctgggtgaccttgaaattgtgcttggcaaaggctggcggcaggaacttgtaccactcgccggtgtagcgctcttcaagaggctcaatcggaatgatgaacagattccgttttgaagtctccggaatctggtcgatcatgccactcatgaaatcttcactcatacttcaatgtctccattaaagtcctcaggataagtgattaccgcattgcctacaacgaatgcaagaacgtgtttctcattctcaatcttgatctgatcctttggacgcaggaaatgcagagtacgagactgagcataggaagcctgcgaaacattccagaagatctcaacaccttcaggcggaaccgaattcaactcggtcaattcgacggtaacgccgataccgctgtcttcgaacacgcctgcaaggtgatgcaggtcaagctcgttgtgatgatccgaaatgtagatcatctcaatgttgtttgcgtatagattgtagatgagattgagaatatctgactcgacatattcccttgccgaacagaaataagtgcgaacgttctcgcctcgcagcataccttctacttcaataccaatcttagccattaaattctacccacctattgccattgtgaactgcgatgtagtttgtgccattgcggctgtagtaacgagtgatcagagtgttgaggaactcggcatcatcgatatcgctgctccaattagcatcaaatgctgcaggaacacgataacccttcatcactacctttcggtcattgtcaaggacaaactcgacaccttggtagtgatcctgctcgctgtaaccttcgaacaaatgatacttctcattggtcagcaaaacactctgagaagggaacagttcctgaagaacagatttcttctttgctcgaatcttcggaagcagaggttcctggaaagagtccatgtctacagtgtagaacatcaactggcaccccatatcccggtgatagtttctggccataatgctgacctgagcgtgttcagcatgagaatcacgaatggttggacagaagattgtatcttcaggtccaagtttttcaagatctttcggaagcccgaagaagtcctcgaagaaatgtggcttgaagccaaacatctcagcagttttcagagcttcgattttgcggtcaggagtgatatcgtagaaatagacaacgtcggtgatcagcccgcgatcaagtgcttggaagcacccgatcacttcatcatcaacgtgtggcgagaatacgatattcctcggtgacttcaataccttcttgtccaatatatgcccatacatcatcatcactccagtccacaatagggaaaatcgaatcattgccaaacaagccgccaaccgtatgagcaggcatgtctgctcggctgatcaactcaccattcactacaacgtctgcactgcggtcggtccgatcaaattcggaacggcgagtgccgtcaatctgaatccacagtttgtggctatccagatacttctgcatctgttcaaatggcacaatactgagaccatatttcgcactctgctcatagaggaatgctacagttgcaggatgtaccttgttgaagccggacaccttaggtgtgtgaatcagaggaacctgatcaccgaacacctttcgagctagatgatggacgacgacggaatcctttccgccgctcgtcgcaacatacacaccgtaaggatcagagactctgaccagcctaccaatggctactctttcaagttctttcaggtgctcgttcatatcaacccttgatcaaagacatcatttccgatcgcagcgtaggatcggtacggaatgaaccactcaggctagaggtgatggtcacgccatcagagtcctcaacaccgcgagtcagaacacagaagtgctgacccttcatcacaacggcaacatcttccgttccggtgatgaacttgatggtctcagcaatctgcacagtcaggcgttcctgaatctgcggacgacggctgaagaagtctacgatgcgcgacagcttcgacagacctagaaccttctcacctggcatgtaagacacccagcaagacagatcaggacggtgagcagtaccaaagtagacgaggtggtgttcacagacagacttgaccgagcagcgctcaatcaccatctcatcgtattcaatcttgttatcaacttcggtgcacttcgggaagttgttgtaatccagaccgtagaacagttcctcaacgtacatctttgcgatgcgcttcggagtctcgatcagagaatcatcggtcagatccagacccagagtcagcaaagactggcgctggaattcttcgatcaatgcgatcttctctttgctcggaacattcaccaactccgtgattggagtttcaatgcccagagcgacgaggtgcttgtgaacgcgctgaccgagttctggattggttttttctttctgcatgttactttcctttacgatttcctatatgataatatcaaccaagtgccgtttcaactggaccacggaacagttcgttgatgattagttcggtatgtgtactaaggaattcatcttcatccacaacgatagattctggattggactcttccgctttgtcggatttcaacaccgacgctttatttacaaggacctctagcttgccattgttggtcccaacatgaatgccatcgaacacgaaaaggtactgagggtgtttcaggtcgatgacttcaagatagtcttcacgggcttcttttacgtagagttccattattttagtttctctcgatcaatccatctagcattcttaggaactacagcacgtttgattgtgagtgcgcgcagacctttcagcagtgggtggctacggtttctgtctttgtcgtttctaatctgaatgacaggctgttcaatctctggcacatctttcaattcttgccagatgtcttcgacgtgaatgaacagcttgttgggcacatcttggaagaagtcattcatagtaaaggactgtctaatgatagcacctttacctttcaagatgtcatttccgaaaagggcgaattccttttccttatctgtcggttcaatcacaaggtcaggattgatcttcctgatctttgtcacaggatccatttcaaaattggtcaaggcgttctcaaatgcgtatcgcaccgatgcctcagcaatttccttgagttccgagtcagccgaagagaagaatgaagcgttgccttgcttcaatgaaacaggaatcatctttccgctcttagtccaaaactcgacgtcggctttcttgtgaccagacgtatcgcgccccgacagatagacttctacaacgcctttgatctcaaacgatttcttcttggacttgaaggtcacgtcaacaggaccaccgagccaaccgacgagtcgattgacacggtgcatcaagtattcttcattgtcctcaccggcgttacctttcaggctagccgatacaacgattgcgataccattgacgttcacagcaagattggagattcgacgagacccttccagcctcaactgaatttcgtcagcgaggcggacaggttcaacgttggctcgatggttcactgtcaaacgacgtcccttttggacaaccgttagcttgttcttacgcaaccattgcgtgatgttcgcaatggttggtggaccgagcatcggctccttagcgtagagccagttcgtcgttgttggtagaaccttcttagccattagatctcttcttcaagcacttcgccagtttcgtaatcaatcgttccagccttgatcatttcagtctgagccagctggaatcgatctttcagcttcgcaccaaaatcagtcttggtgaggatcggcacccagaatgcagcagtgttcgtatcagcctgacgatacttcttctcttcgcctgcctgctgataccaaccattggaaggcttcacgacatgtcctgtttccagtgccaggtcgagcagaccggaccaaggcgagataccgttctcgaatgttacctcgaccggaatcttgctcttctctcgtacatagcgagacttctcaacgttcaggacgaagttgtaaccaacgatatcctgtccatccttgttctgctggcgaccaacgatgtagatgttgtctgccgagtagatcagacctgtaccaccggacacgaccttcttcgcgtacatttccatcgtatcgtaggtgtgagccacgacgtgcatacagagactcttgagtgacaggattggtgtcaccattcggaacagagacttgaacgcctttgcgcgtgtcatgtctgcaaccgacttaccgtccagtgcgtcatcaacttccttcttggaagccaggttaccaaccgagtcaatcgcaatgaacaccttgtcgcctcggctgaggccatcaagctgcttcataatgtcgaacttcaactcttcgatgttggtaatcggagtgtgaacaacgcgatccagcggaatgccgaaggacgagaagtaactctgaggagtaccgaactccgaatcgtagaacagaacaacaccatccttgtacttgtcaaggaacgccttcatgttcgtcagcacaaagctggtcttgaagtgcttcgatggacctgcccagatggtcagaccaggaccgaaaccaccatcaagctcacccgactggagaaggttgaggactggaatctttgtctgcactagctctttcttctggaagaaggaactcttctccagcgatgcagtctctttgatagtagactgcttcatcaatttgtcaaccaaactcaactttcttctccttcatcttcatcgtcattatcgtcgctaaagcgtccgagtagtcctcgaacgtctggaccgatatcttcttcaccaatgtcgtcatcaacgcccatgtgagcagctgccctcttccatttgtgatagaagagagctggagtgatagaccagtcgaggacttcttcgaccgcctgcaccataggatagatgtgttcaatggatgctacagtctgtcggaacacgtcaagaatcttttcgtgttccgcaaactcagccatttcaggatcaacttcaaccattgacagttcgttctgcaaactggccaacagattcagcatctcgctagctgcactcatacttaaacccctcagccaaacaggctttcaagagagctgaccttttcagtcttccaaccgagaatgtcggtgaaggacttcaaaggagtgatgtacgttgccgtccattgcttgtccttgtccaggtactcgtgcagaccaaagccttcaggtagggtaccattgaatgcgatgttgctgcatcggcaaggattaattgccttgagcgccatcaacctcaccttgtttccgttcttgattcgttcgacagtcttttgcagacccttatcaacgatcaatgcgttgtgcgcgtatgctgcacgaacgtggtatggagccttcggcaagagttcaccgctgtcaccaatccacttcgtcagatccttcacacccttaggcgaggcaatgttctcaataggagcattataaaactccttcttgaagttatcaatggaagttagcaactgttcctgagtgcctgtcagcaggatctccaggtcgctctcgagcttcttacgaaccatcatcggcttgtcgcttcgagcagtctcgatacctgtcatcttcagaatcggctcatggtagcgaacgtgttcgttgtcccacactcgaagaacatagttcttcttaccacggaagatgccaacgtctgcgattgcttctcgcttcatgtcaagcaggttcttctttgcgccaagtcgatcagacagcttctgatatgctgcattgatgaacggtgtgaactccttctcgaggaactcgtcaatctcatcaaccgactgctgaatgttcttcggatccgaaggcaggttctccaactggatgtaagccgagtcggtgtcagacgtgatcacatagtccttatccgttccaaacttcttgttgagatacttgttcatcatgttgccgatgtactggatgcccagctgaccggtcaatgtgatgccttccgcgatgctcacgttgaagtaacggaagcccttgttcgccgatgcaccgtaaccagagttagccagaaccttcatcgcgccctgggttgcgtctgctgctgcaatcaggttgtcgaggcgcagatactcttccgaaccttctgtaccaccagccgcaagatatgcttccttctcgcgcttaaggtcgagcattcgattcttctcagccttacgagtatcgaatacgaacttcatacccttcggcataacgcccatcacgtcctgtcgataagccgaaccgtttgccgccattgcccaaccctgagctcggcaatccgcagccaggtcttctcccttcaacagacgctcaacccaatccagctgaccttgctcttcacgaaccagagtttcagggctcatgttgaacatcatacagatcgacggatacagcgaagtcaagtcgagtgacgatacccaacggtacttgccaggtacaggctccttaacgtatgcgccaatgatgctacgaccgtgcttctgcaccgccggaggaatgacgacattttctgccttgagcagattgtagatcaggttgtcccacagcttaaccttaccatccttctcctgatatcgactcttggtcatcagaacagtggtgatcacaagtcgaacaaactgcttcttctgatcaagtcgttcaaccagataaacgtctcgttcgttgtagtcaatgaacttttcgtagttctgttgatacagccccatcaggtcgccgtactcagagtaatccaacttcttctctttcagctcaacctcagagatgaaatccagtgcgtaactgtcgcgcttgaccgggttgtaacccttatacatgtccatgtaatcgagagtcgtcacaccaaagatgcgatagcccttctcagtcttgtcgtcatcgatccagtattcctgaatgcaacgatcagtgtgagcatggaacggactcagcttgttcgtcagcttctcaccgagaatagctcggcaacgattcacgatgtagggaacgtcgaacgactcaatgttccaacctgtgattgcgtctgggtcgaccacacgaacaaagtcaatgaacttctgcagaagatctctttcatcaacacacagattgtagatttgattcttgtcctttacagcatattccttcgtaccgaaggtgaccttttgaggacgtccaaacaccttacaagagatagacgtgatctcatatgccgcattctgtgcgtcagggaaaccgcccggattgcgctgaggtgccttagatgcagggtaccaacgttcattgatcggatcatagacttcccaaacgtcctggagagtcttcatgtaaccaacggtgacggtctcttcttctagactgaacaccttacgaaccaacacctcatcttcatcgtccttaccgtcgaatcgggtttcgatatcgaagttgagaacgcgatacttgtcaaactgcaattcaatcttgcccggataacggtgcgagatgaactggtgatgcatcgaagtctgtccgaacacaggaacggtgccttcatacttcttgatgaagtctttggcatccgaaatcgtatcaaaggtcattcggctgagacggtcaccgtagagcgacttgtattctccattgcctttgataaatagctcgataggaaaacttgtaacaatttcttgatggcgttttccggcatcatccacatacctgtggtaaatcttacttccaatcgaatcgcaaaaggtatagaacgccattatgtctttactctcctcatttctagcatggctagccgtcggaacaaacggcttcctgtttgctgcctcatgtgcagcactagtcttcatgctaatgattgcttatgtcttgttcaaggcaatcaggaaacttgacctcagctctatgttctacgagccgggcaccctgaccgtttcatctacaaaattctggaacgtcgttgcctgttttgtggcgaccatcgcgttcctattcatcaatatcactgcgccagcggcagcatcacttgagtttatctggcttgcgtatcttggcgtcatcgccggatcagcaagtgttagcaagctgatctcggcgagatacggtgtttctaatgaatcagctcagaagctgaatccctgatccgaattgctgagtatacgcattgcgtagctcagtcagcggttcaaacagctgcccaccgaagcgaaggtcctctggctgcagagtgatcttcgtttcatcggagaacatcaggacaggcatcatgctcagtccctgtgcacctggcgcaacgaacacgccatctgtgacctcataggtcttcttgtcgcccgattgcgagatcagcttgaagtcgccgaggatctgaccttgagtggtccataccaacttgatattgctcattacttgctccctgttgatccaaagccacctgcgcggctagtcttttgtgctggcttagtgtcaagcctcttaaatggtgccttgacagcgggcatcagcagcccctgagcaatgcgctcaccgtcttccaggactaccctggtgccactgttgttggtgaccgagacaaagatctcgccaacgtagtctgcgtcaatcactgcgacgccatttgtcagaatcagaccctgcttccaggaagtaccgctacgtgcgtgaatcgcgatgtagtagccttccgggatgtccgcgtgcaagccggtaggaacgagtgcacgatcacctggctccagatacagacgcgccggagcgttgtcctgtccacgagcagtgatttcaatcttctgattgcgatgatcgtacttgttgatcacgtcaccagcttcaatgtcaacgctcaggtcaaagcctgccgaaaactctgtcgcataatcaggaatggtcttatttcgcttctgatagaagccaaccatatcatcttcaaacggtgtaatctgtccagtgacagctacgctggacatatccagcgcgccgaggtctgtggtctctacaacttctttcttagctctcgccattatcagtatttcccagagagtatttcacacgaaggttccacttatgcttttcgcgataagggataatcattacgttcgattcaattccggtatcgacttcaaccatagaagtgatcaaaccccactgctcaagcaagttgacgatgtattccagacgatcttcatcttcatcggtaaagtcggtcacgtcggttcggccatctagcaggaacaactgcttgaaatggacgatgtagtaacgaccttgcttatggaagacgtggcatgtctgccaaagagtctgatcaccatttcgcttgctaggcaacccaatacgggtcaaagtttcacgtaccttcagaaactgatccttgttcaaaggctcaatctcgaagaaggtctcaagcagttcctgctttctgttttgcgacatttttgccacctttttctaattctttgcgaatgtcatcaagataaggtcgaagaagtccgagcacatctttggctcgtttccgactatatccgtagtattcctgaattagatcgagcgacgctgtgtcgtcctgattcttgtgccacttgccgaagcgcttcttcttcggcagaccatggtaatagaagtcaaattgtgcctgggttggaagtgcccagtaacgattcatctcattcgcgaacaagacactatcaattgtgtttgacagaaccttgttgactacgtacgaactatagccaatttcttcaacatccagcacacctttcttctcgttgatgtgcgaggcgatatcaaatggactcatagatgccattgttacctcctagatatttacacaaattcaacgtctgccatcatggtggtcaacatcgcaacggtgttgatttccttgtccatgacgtgaccttccttatagtcgtactctgcaatgatcagaacaagctgaggaatactctgaggcttgacaaagaccgtcatcttttcatacagactgcgacgcagagatgctgcatcattgtcaagatgatcaacaacccacttgcgcatgtcgctgaacttcttgcccttcaggtaatcaatcagctctttcagagcaccatcattgatgccagtctggctcgtaatctcgagaacgccgtttgccgaataacgctggatcagattccaagtcttacggaagtcagggaagttcttgatgatgacctgagtcagttcttctggagtgaaggtgatgttcttcgacttaagaactcctgcaaccttcttcaagaactccatcaacagagccttcttctcttccttcgtaaacacgatctcaacgatcggtgctcgactggtcagaggttcgatgatctggttaccgaagttgccggtaaagatgaagcggcagttacctgcaaactcttcaatcgaggcgcgcagagcttgctgagcattcttggtcagaccgtccgcctcgtccaggatgatggccttgatgccacctccgaagctgaccgtcgatgcaaactgtcgtaccgtagtacgaatcgtctcaatgttgccgttctcagacgcgttgatgacgatatgatcgattttcagctcttcacacatcgcacgtgcgacggtggtcttacctgtacccggtccaccaaccaacgtcatgttggccagttgtcccttatccacaattgcctggaagtaggtcttcaaacgtggaggaagaatacagtcattcacagtgtgcggacgataattctcactccacaggtacatttctttctcgtcactcattatcaatatctcacagttgttaaatcagcctacaaggataatttgattggctcgatgcatcaatgcagctacatacacgttccgaatctcctcagcagtcttcaacgatgcatcatcaacccaaattcggtcaaaggttcgaccgcgaaggctgtaattctcgagaaggttttgtgcaagtgcaaccaaaggcttcttgacagagttctcacccatggtcattagctggaatgcagatcctgcaacaacgaggtcatccttacatgcaaggtgacaaattgccgtcgtgtgtccaacgcctctgcccatctgaattcggatcgtaccaaattcctgcatccattgatgcggttcgagattgtggcggtacttagcattgagcgcctggcgctggaggtttagctccagcgcctgttcaagaatgttcttgaagatggcggacatattacttggcctcgacggtgaccaggtagacgagacctggcttggtcatgtggctgaactcaactgcctgatcgaacaccttgacgttgtacgaaccttcgatgagcttcaggttctcgatcttgacgagcttctcgtcactcatggagccttcggtatccagctcaatggtgatctggttgccaacgccacccgagttgagtgcggtcagcttgccttcacggatcgacagctccttcagtttcagggtagccgcagccttctgaatctggttgatgttgccttcggtcagttcaaaggtcagcttcggatcggtcagaacgatgtccttgtccggcggcgacacaacaactgccggcgagctatagaagtacttgaccttggtctttccgtcctgaatcaggatgtgatcttcattgaaggtcaggtgcggcttggagaacaggctgatcgtgcccaggaactcgttgaggtcgtagatagcgaactcgcgagtaatctcgtcattgatttcagcgacggcgaacacgttcttcagaacggacagagtgcgaagacgattgcctggcttgaacaggagaccctggttgatcgaggcaaagttcttcagaacattcaaagtttcagatgacaaactcataatttacaactcctaagtgaacaatatgtgcttatactaacaggtaggtgactgaggcaacatgtaacctcaggcatgtatcaaaatgcagcttcacctgcatggaccaactcgtccagccaacccttccaaccggggatggcaagagcctcggggcgttcgccctcaaagaacgtgatgcgctcggtgatggtgttctcaccgagttcgtacagatagaagtactgggtcaaacgcttactcatgatcttttaccattggtagtcatagaaatactgaacgtcctggctccatgttgagaaacgcaggtggcttggtccaacgaccttcatatcaatttggactcccgtcattctagcatagtcggctagatcaatacggatctctcgatatgttacctcatccgacaaatcgtagaggtaatcgttgaggacatttttacaggtgtcctcaaagaactgttgaaagaatgcgctcattagaaaattcctcgtacaatccaattgaatccgccgatatgaaaaacccttacgacagaatagagagccttgcatttggcttctctaagagtctcaacaatgtcttcggagtcggaaccgcgtgataccgcagttcctccgtcaagtggatgagccatgagacgaatcccaagctcagctgcgtattgttctgcataatcaaacgatgcgggagaatccatctactttctcgatcttcatggttgaacggaccttgtcaatgatcttctctggagtgtgcgtgacgatgaagacgttcaagtccttcaccagtgcaagcatgtctgccaatgcgtcagcgccgccttggtcaagcgagctgtcgaagatctcgtcaaagataaggatgtttgttgcaacgttgccctgcatccgtgcgatatcgcgccatgccatcagcagcgccatatccatacgaagcttctcaccttctgagaacgaattgtacccgagggtgtcaaagccgcgagccttgatcgtttcgtcgaagttttcatccaggtggaagttgacgaacagaccgaggtgattgaggtgagtgttgacctcatgattgatgatcggaatgaagcgcttgatcagcatcgtcttgatgcccttgtcctgcagcatcgtcccaatcaagctcatgtaatcgctcttggtgtagagctgctcgagcttgtctaccaacgcggtgtgcatgtcttcgagcttcttcaattcaccagttgcttccttgatcttatctgcctgactgtggcgttccttcttagtctcagcaacaaggaagtctcgcttagattcagccgatgcaatctgcatgtcaaccgatcgaaccttctcgatgtaggcatcatacttagcaaccgcaacctcgaactcagcaacaactgactcaaactgctgaatgcgaatagacaattccatcttcgccagatcaatctttgccttcttgtccgtgaggtgatcaacctgtttagcatgatcctcatgttctagcggacgatggcaggtagggcaatcctgagactttttcaactggcgcagactgttctcaatctgagacaacgaagtgtccagcttgacaatcatcttggagtgctcagacagatgattcatcgccttcttataggcgtctctgtcaatgccttcaaccgtttcaatctcgttcttacgcgcatgtagctcggacagctgagcagtgatttcgtcaatctgagcattgatgcgttcaagttctgctgctgcattttgcttgtcagcgttcttgaggtcatcaatgtacttcttgcgaatcttgatcttctctgctgcgacagtgattgcagtcttgagttcaccgatgcgattgcgaagctcggttgtctttgcattgtgcagacgagccatgttcgagaacacgatcaggttcagcacaacttcaacaaacttgcggcgctcgccagtattgagctgcatgaacatcgtgtgctgagccttaccgaccagaatgatctgacaggctgcatcatagttcatgcacaggatttgctgctcgaagatcttctgatagtctcggttgttggcttcctgattcaggagcttaccgtcctcgaagatttcaaaaatgccaggcttgatgcctcggcgcacaaggtagctcttgccatccttgtcaaattcaatttcaaccagagcatctctaccattcttagtgttgatcagatgctctttcttgatcttacggaaaggcttaccaaacagaccaaaggcgagggtgtccagcaagagcgaactcttaccgacaccattctttccgatgaccattgtcgatggtgagcgatccagctgcacttcggtcataacgtcgccgaaggacaagatattcttgaatctcagtttacgaaaatagatcacttcttcacccacagcaactttgattgaggatcaactggctcatagccttgtgctacaagatcttctgtggccattgcattcgcgaacaggtccttgaccactttctggtcaattggctgcacaccaacgagttcctgagctaattgcgcaggaaccgtttgtcgaatcatgttgattagattttgatcaatcattctgtctccgccatatccagtgcctcacgatacatttccttgaacatgtccttaaggacgttcttgtcaatggtcgggctctggacaacctcttcgatgtatttctcaatcagctcatggttgtctacgaattgcagatcaccagtctcgctattgaattgagtctcgtcgatttcgatcaggtctgcgctatagacaaccttgttcaacttctccatgaacagactcagcttgtgctgattggtcgaggagtaagactgcacgtagacgcgaacgatcttatcggtatatccatcgtagtcaaactctacgatatcaatgtcgtcattataggcgatcttggagtagacatcaaacggatttggaacaaattccaattctctcgtggtcgtgtcaaagattcggaaacctttgtcaagaccgtagtcggaccaattggtctgagatggatttgagatgtagaagatgcgaccgtcggtagagaccgtgtggaagtgaccagagtagacctgatcaaagcggtcaaacaggctcttatcgaaaccgtgttcgcagacgtgacccttgatcatttcaaacgacttgatctcgaagtgaccgcacaggatggtaggcggacagttcttgatgaaatcaagactctcagcgaggttggcgttgttcacccagctaaggaagttgacaggtgtaccatcaaactcaattgtctcgtgtgtcttgaccacacgaatgttcttgtacatctttgccaagaagtcgatcgagttgatatcgtttcgattcttgtaggcgacgtcgtggttaccatagatgatggtcacctggataccacgttcctcgagcttgtcaaggtacatggattgggcgcgccagagagtaaccacgtcaatacgagttctgtattcccagaagtcaccaagcatccagacatgagtgatgcccagttcgtcgatggtagggaagaagatctcattgtagaacttctcgtagttgtccaagaagtacttagaaccattgcgcacgccaaagtgctggtcggtgatcatagcaattttcatatgatcacctcagtggttcatgaattcgacgacgtcgtagttgtcgatgtagtgactgtgatctccatccatcgtcgagaagaactcgttgacaggatcagtcatcatgtccatcttggtcttctggagcttcttctcgtaggcaatgtagcccaggaatgctcgccatacgcacagggagatgaatccgaacgggttaacctcaccgttcttacccaggcgctttggatcgaaggagttcatagcgcgaacggctgcgatgatgccttcgcccttcatctcttcgatataggtatagttacggaagttgggacgtgatgcctgaccttcagctaccttcatgattgcatcgcctaccgaatctggtaggggaggtgccttcttgcctgcagcgattgccgtatccttccgaatcttccattcacacaggtcagcgtagagtgcctgcttgtctacatagtgatttgctttcttcttgtcttcggtcaatgctgaaaatgccgtattagtgaagtgtcgtagatctaggaacttctcgagacattagaatctcaaagtgttcatcatcaggggtagacgcaaccttttctctcaacctgatcacgccggtgtaattactaaccacatgctctgatgggcgcacaatggcgatcatctgattgttcatgaagggaaccggagtcaaatcaagtggattgaaatatgccatctgatccaggaaaggcgtgaactcatatccttcaacattgtctgtgcgttcattgtaatcaactgtgaccgtgtagggtcgcagaaccatcgtagtctcagggaagactgcaatcacataaccaatgacattcaaaccgttttggaagtgcattagccgaatcggataggccttacccgattcgactctgaccaaatctactgcttcttcagtactcattcttccatcttgatcgggatgatcttgtacttccatttctcacctacgtagattttgagtctttctaggaagtggcggagaatcgtattctgcttctttaccccactgcgtgtagtataggataaatcgtctgcaatatcaatgagttttacatcttgtttcccttctgccgttcgaaggattcgtccaatcgactgaagagttcggatgacggctttgatcgggtgacagaagatcagattgtgcaggttcttgacgttgacgccgaccgccagcgtaccgtacgatgcgagcaggatggcgttgttttccttctctaggatctgacggatctgttcacggtcatcaactgcggtcgagcctgaaatgaagtacagcttcttgccatacttctcacacattggcttcatcaactcatagagtaccttaccatgcttcgcaacatagttgaacagcatcaaggtgttacccttctgaatcaatgcagtctttgcgagcaggtagttgcgcttaggatggctaacaaggaacttgatctcgccatcgtagtccatgttctttacgaggtcaacgtcattcttgctatacctcagctgtaggcactcaatgttcaatggagccagagaaccttcatcctgcaggtcctttgtcgaggcaactcgtacaatagaaccgaatcgagcctgcatgtcaagctcgtgcatcttggtaccatcaagagtacctgtcagaccaaggcggaacggagcatggccaagctggtcgatgatctgagaaatgctctttgcgtctgcaccatgcgcctcgtcacagatataggcagagaaggactggaaccatgccttaggcagcttgatagccgactgccaggtggagattacaacacggtgttcggtgtacttctccttaccagagtagatacggtgaacgttctcttcaacgtcccaatcgtcagccacatagtccttgaagtcggagaacatctgctcgacgagcgacgttgatggaaccgtcatcaagaccttaccatcggtgtggtcgagcaggtaacgtgtgatcagatactgaatgtaagacttacccgaacctgtcggcgacagaatcaaggtcttggaatcattgatagctctaaagacggcttccttctgataccatttaggctcaaacttgccacacttcttgagctcgttccaggactcttcattgatggttgggtactggcgctcgaagtccttcggattcgcgtaatcaatggtgtagccgttttcctcagcccactcaaagagctttggcaggagaccaatgtagaagttgcggtccttgatgttgtaaaggcgtaccttaccatcccaacgacctgccttgaacgcaggcatgaacttgtatccattgacgaagaatgcaaacgcctcagagacttcataggaaatgccgacagagcaatccagggtgacgtgtaattcgttcttatagtgaagtttgatatctgcttgcattcttcgtgcctaggtcatccgccgttcttgaatctcaggaattcaatggagttcttaatgaggaagtttcttgtgttcaatgtcttgatgaaggcttcgagcatctcagtcttcatcttttgcagctcatatttcgatttcagctcagtcaacttctcatctgcatcgaggtacagttcaaggtcttgcctgaggattttgatgtctttaggctcagccttgtagacttcatcactcgcctgtcccagccaatactggtggcgttctttcttcacacgcttatattcaatctcgatgcctttcaggatacgaagctctgcaatgaagtaattgtagtacttcgagtgaagcattggaatcctcaaggactccgtatctagggcattgttgttgatttcagaatctgcagcaatttcagcttggagttcgtccagacgcatcgcgaataatctcaaagtattgataacggaatgttgcggagcagatcagaggtgtcgtatcgttgacgcccgaatcaaacgggatagaactcaacatcgtaggatacgccttgtggaatctaatctgcatcttatgattgcgagacgagttagtgatgtggagaacaatgttcttcatcatttcagggaccacaggctcggtcatggtgatctgaatcatccactcatagagtgatctgtagttttcaaaatcctctgagacaatgaagttgatgttcagaggatcaaactcgactctattactggggacgttcgtaccccagttttgatatgcggtttcaacaccacccgaagatactgacggaatttccgtagactggacggtgtagttaagcgtctcaaagcccggaatgtcgagcttgtagcttgtgcctagcgcaggatttcgattgatgtgtttactggtcatgccagtatttaatcggtcaatctcaggttggctacgatgttctgtgcaacaatctggagagcatccaatgatccggagttggtgacgaccaggtctccatcctcaaaggcaacacctgcctcagaagcgtgcgcagccacagacttgagacctgggcgttcaatgtggatgagcaacccaccattgtccctgatccatgatgcttcattttcaaagcgaacatcagtgacgagaagacctgccttgcgagtttcatcgagcctgatcttagccatgtgaatccagatatcatcacggagcatctgacgcccatactctgttcccatcaattgcattgcacgacgcggactgaaaccccaacgaggatcaatagcctctttgaactctctgtcatgatcaatctgatgacgagtccatccgaacaatccgcagcaagcatccttgagtggacctgcaaacgaatatggttcaaagttgatgaccttgttgatgaaacctgcaaaggtatccttgcctgttcctgccttacctgttagtccaatgagtctgatcatacattgacatccatgtgacgaacgaactcttcaagctcatctagagtgtaggaacctttcttgatgtcttcaattcgattgagaatgtaatcacgattgtcttcattggcatcaacaatgtcttccgaaattgccttccatgatagaacgtcttcttccaattcagcaatgcgatctacttcgcgttcaatgaggctaaccacattagggtccatcagtgtccaattggctgctacaaagtctgccaatgtcattgaagaataaaactgcatacgcaactcctagtaatatcaagggttctacggcttttcaaaattaccccttcatctactgaaacctagtagtatcaagggatctcactttcttgcttaaaagctacaccttccacgtgtgtctatgtactacacgccgaatcttttagcctcgggcacgacacctcggtggcatctatacacctttctttattttctttctaactttctttctatttgctacccatctggttcaagagcattttaacagtcaagaaagatgcatcatagagatgtacgatcattgttcgtcaactttttacgagcacagcgagctttagctgcctcagacatgcgcttcttttgctcctcagtgcgaggcttatgcttgatgacaattcccagctcacgacgttttgcagcagcggctaactgtgattgacggattcgctctacttgctcaggggtgcgcttgcgaccgtattgagggttgttctttccaaccttaccgtacataggattcttttcacctgaggttgaatcgctaatcttctttttatgttcctcagacttcttgttgtagatgccacgctttatctttgtctcctcgctctgcttgcgtcctttaactgcggcgagttgtgcaggtgaaccaccctggggtctacctgagatgttttgattgagccatttgtcgttgatatgagccttcactcgtcttaggaactttgtctcaaacaggtaagcctcatccttagtctcgaattccttgtgaactcgaatcacatcagggtcaccaaattgtgctacaaattcgtgaacatagatagaggaagtcttgtagacatgccagaggtcgtattccgggatgaccacgttcgcacttctcatgccgtaatagtatttgtttagatcggtccagccgattaggtaagtgtatgccatagtcctatgatattgcctttcacctatagactatagaaaacatagatattcaaccaaaacaaaacccgccgaagcgggtcttgtctgaaatcttaccaccgttgccggtgccaagtccctcactattacatgaggttcttgaccaaagccttgcgatagtaataattcgcgttcgaaccgatagcggtcgagttgcccacgaatgggttctcagccattgcataacgggtcttgaagcccagagcagcgtggaagttgcttgggtcggtagcgcggtgcagttccagaggaatgtatggcgcgtagtacagacctgcgtcgtactgagtcgaacccttgaagccgaccaggtaagcatcggtaccgaggtacggatcgatgtagaccttgaagcgacctgcggtaccggcataagttgcaccggttgcgtcaacttcgagcgaaacctgaccctgaagggctggagcgtagtccagaacgcctgccatcgcgagtgccgaagcaacgtcggacgagacgatcaggaagttacccttaccacgacgggactcgattgcgatcgcgttagcgtcgcgctcgatagcgaacagcagacccttgaagcgctcaacagaccaacgtccgtcagcgtcagcgttcaggtcgaaggtacctggggtagaagcaaactgtgcaccgaccttagcagcgttgtagaccgtacgaacaacctgacggttgatttcggagatcagttcgttgctgaggatctgaacaagctcagcatccgcatccagaccgtgtacgcgcttcatgtcctgagcaagctcaatggagtagtctgcacgcagctgacgggtggtcgccgagatgttgaccttgtcgatggtgacaccgaccgagttccatggatcaacttcgcctgcgcttgttgccttaccggtaccagttgcgaaaccagtcaggaagtttgcgtcagtgatagctgcatgagtaccggtaccaccgtaggaggtatcagcttcctgcagacccaggatttcagcaccagcctgaggaccagtgttcggcggggtagcagcacgacgtgccttcagtgcaaagatcagacccgacggagcggtcattggctgcacaccgaggatgtcatatgcgatcagcttaggagccatacggcggaccatggagatcaggacagggtcccagttctgcacgccggcggtcaggttcgaagcttcgttcagtgcttcctgtgtgttctccagaagctgagcagttaccttcttgcgatacgggtcagtaattgcatctgccttttcgctttcaagaactggttcccacttctctaggagggtatccactttattttcttcttgagacatcttttgttctcctaaaaatctcaaatacgaattaaacaattctcagatatttatgttctgggaattcaacttacagaagacccttgcccatcaggcgcaggacatctccattgacttccttcttagccggcttagcttgctcgttgagcacttccggggtgtcggcgagaggtgaaacctgtgctggggcagccacagcctttgcctgctcaacgatcattgctacgccgtctttgtactcatcgagcgaatcgaacgagacagcctcaagcaattcatttaccttctccttctgagtctcagccagatcagcaactgcgcgctccaggatcagagtacggttaagcttctcgagctcttctctagcagcagagaggtcttcgaagagcgactcatactgagcggtggattcctgcagggattcctggagctcaataacagcagcatcttccttaactgggaacgcattcttctcaaatgcttccttgatgaactcgaacgcagacttcatgcgtgcgtgttcttcggtctcaacgaaacgttccttattctcagtgatgaatgcatcaactgcgaactcagcgtattccttggcctttgcgatgacagactcctgaatcgactcgccgtaagcgttagcctttgccttcaggtgttcaccatacttgtttgcttcttccttcaggaatgcaatttctgcctgatgtgcttcttcaagggcttctttgtccttctcagcagcttcatcagcttccttcttgccctcagccttaccctcttcctttgcagccgcgaatgcttctgtcaggatggtctggatctgagttgcggtgtcttctgaaagctctagggtctccagaagttcctttagttgttcattcattacttactcctaagatctttcagaatgatgttttaagttctacggtatttagttctcagaaattctcagttttcgcgtccattgctgagagcgacgagcttcttgaacagttcaatcatcttggcttcgttcagtgtacctgtgcgagctgcgtgattgatctccttcttaatctccacttcacgttccatcaggagaccgttttcccaaacccattccttaccttccatcaggttggtcaggtatgcgtctggcgccgacgggtcagagacgatatcgcctggggagatgagcctaaagctctgcaccacagcagtcttctgtccgcgctgctcgaacatcttggtcttaccaagagcacgagttgacgtacccatgttcacgccttcatccatcagaccagcaacgatacgtccgtttggtgtgcctgtggtaacgactgcgcgaccgatccagttgttgccgtcctcagtcagcgactcgtacttgtgagacacttccttatagtcgttacgcggatcgtttgcaggatgattgagatgacctactgcacgtcctagcgcaatctcttcgcggatgaagcgatcgatctcaggcttgatcagttccttcgggtaaacgcgaccattgcggttctttacctcagcctggatgctgataccttcgatgatgtacttcttgtgcttgattccgccaacttcctcagtgaggatctcattacgaacatcgtcaatgcgttctactagtacttgcatttcctgttctctcttctacttaatagccgtgcttctgatcttcgatcttttcagcagcggcgatgtgatgctcagatttctcgtggtgttcggcagccttcttacggtcaccgatcttatcgtgatgctgggacatcacagcatgtccacgtgcattgtgcttatgccaatgcagcgtgttttccttgtgccttgcagccttgttgaagtgatgcgtcgccatcatcgcaaggttctgctctgccagatactcttcgaatctcattatcgacccaacccaaatgacttacggaagcggttagccttgcgggtcttgcgaataacgcgagccttgaacgactgacccatcgacttcttagtcagaacagcacggcgcattgccttacgcatcacagcaacctgagcgccagagatcttcttacaggtcttggctgctgcatcccacttgaagccagggctgcactgcatcttgatgcgcttcttaccgcggaagtttaccttgatcttacggcgaacctcggaaaggaatccgttgtcggtgtcatcgtcccattcaaactcgtcaccaacctcgaggtcttcagcaggcagcatgactagttctggatcaatgtagacatagacgttgaactcgaagtccttgtcgaacataatgtcgccgaagtcgtattcctgatcttcgacaaagccatgaacgaggtcttcgcgtacagcttcgatctcataggtgtcaacaccatcagcgccttcgaggtaggtgcagtagtcttcgcaggccttcttattcttgaaggtaagcatcagaacaccggaagcatatgctccctcgtccgaaccaagctgacgaccattctcgcgcagagtcagaacaaggtccttctccgcatcgcccatggcggtccaatctgtgtctgtagtgtccttacgaacatgctcttccagaggcagtggagggcaaacctcgccgctctctagacgctcttcaaggacgttagccatgtggctcttcatttccttgatgaagtcgtaggcgttcaatttgttgatatcaattgccattaagcggctccttggttttcatcgaatgggaatgttgtcgcctggctggatgtcagcgaattcttgctcctcaccatcatcagactgtgccggtgccgctcctgagaactgtgctccgttgttgccttcgccttcagcatctgggtcatcatggatgcctgctgcgtgttccttttcaagctgcttatcttcctctgcaatttccttgtcggacatgcgaaggacgttcttctgaacatacagcttggagaaatacttgcctacgtgaggatcgatagtatttaaagtattgagacggttgttgaggatctctgtttccttcgcttctacgaaggtattgtcctcagtgtagttccatacaatatcgcgcttgatatcgttccagtctgcgtctgtgatgatcttcttgagcagcaggttggtgcgcaggatgtcttcaagtacaggaacgaatcgagaacgcagcgtatgcaggaacttggtgaagcggtattcgtcacgggtgatctcgttacccttaccaaacaggtttggtgcctgctggtcaccgaagcggctacgtggcacgccaagtgaacgccagaacttatcgcgcaggtactcgatctcatccatgatatcctgagagttctgaccttcaatggtcgtaacctcagtggacttgccttcacgacgcggaagccaatagtcttccaacatggtcatgatgttacgacgatcagacagctgtcctgtcttcgagtcatagaccatcttgttcttgaacttggccatgaggtctttgatgtaagcctcagccttgttcttttgtaggccagaaacgtcaacatagaaggcgcggcgtgcaggtgcacgaacgacacggaagatgatcatcgcatcttccatcatcttcagcatgttgaacggaacaatcgacttcttcaggtaaccgacatatcgacccaggtttcggtcaaacagaccagagttcacataggtgatgctctctggacgaatctgaataccttggatagatgtaccatgctgaatctggatgacctgattgagcgggtgcgccttaggatcgaagttgctatagagatagaactgcttcaccttggaagcatcgtaggttccatcaggattcatcttaggcatgacgcggacaagacggatcttgagcggatcaatgaactgaaccttctggataccctgctttagcttgttgtagtccaccatcttgtagaggtagatcttggaatcgacataccagtcatcgaaccactgagcgccattgacgtcaaagtcggtgatcttgtatacctcatcaaactcggatgcaatcttcttcttcattgcagcagagagcttggattcctttacaaagtcgagttcaactgccttcttgccagggacgtcgaagatgaaaacttcgtttcggatttcctgcaaggcttcatcgacctcagcagtagctgcaaggtcacggtaagatcggatgagctccgcttcgtcagctggagtttggagcaactcatacgggacagacatgacgcccgcatggtcattgtaataagtctcaggaacgacaacctcagaggtagtctcacggtcaatgctgaacgtggttagctcttctttaggtcctgccttcttccagagttcgtagccaaaaatctgcattagatttccttcatggtttcacatgatatttaatccaaagaaaagcccaggtatctcactgggctcttcttcgttccatggattagaaacgagtagcagtagattcccaaccattgattgcgaacgtcactggctgcagagcgatctggtcgttctggtcgtagcccagctggatttcgccaaccattgttgggaagatgccgtacacgcggtaacgctgtacttcctgatccgcgcggtccagagtgatgatgtctgcctgtgcatacgagaagatcgggttcagcatctgtggctgagcaacgttggtacggaaaccaagcagctgatcctgccactgctcaaacaccgaacgtccgaggaagtcgttgtcgaggaggatctgtacagtccaatcgccccaaaccttgtcacctgggatctttacctgacgacccatgtaaggcacgtcaattgcaccgagtgtggattcaggaatcgaagccgactggcaggtgaagctgatcttggtagctgcttcaacagcgcgaccaatggtcagagggaaggaaatgttgacgcggtaacggttagggcgagcgccgccgccacgaaagtttgccaagaaggagtagacgtccgcctgtgccatgatagttatcctttaaaagttgagttagttatgattctctatggacccaaccatacttctgagtatcgtcagtatttagtttctgacgaagtagtgagcaccgccatatttctcaccttcatacttccaacccttagaggtgaacatgcgaaggaaagatggattgcggatgaacttgtcgtataggtctcttagaccgtattcttcgtcaccttggaatacgagttccttaggcttcgccttgtcgataaccttgagtaggacaaatgcaatgcgattgtagaaatccagagccaacttggcttctcgagcaggcttgatgccaccgtaatgattggtgaaaatgatctcaccatcctcagagttgcaacctaccgtgatgcgctgaccattatactcgaggtatgtccaaactcgtccatgacctgtgttgaattgtccattgtcagctttgtcattgtttccaaaaggtacctcacgaaaaccaaatgcttcggctagatattcttcaaatgtcatacttaggttaccaattgtcatcgttctatttagacaaaagaaaagccccggtttcccggggctcaagaatactacgagtagttcttcttagaatgtgccaccgaccacttcgtcgaacgagacgtcctgacggaccgcaacgaagttgagctgtacccaattgatcgagtagacaggcttgatgaagatcgagccgacgaactgacggttcatgatgacctcagcggtgttgttcgacgtatcgcaaacaacgcggaagtcttcaataccaccacgaccgcgaacctgttccagcttcggcgaaaccatgttcacgaagttgttacgtgtgaactcgttgttggtctcgaagaggtagtacttagcagcagtcgagatgtccttctccagggagatgaacagacgacgggtaccaatctgaccgaatgctgagttcttaccgagcagggtcttgtctccgtagagaacagttccgtcggtgttgaacgtgacaactgggttgataccgaccttgtagatcgcatcacggctggtcttgttcgggttgaacgccagcgagacaacgttcttaaggcgaccgcgagtgtaaccacctgggctagtccatgggtcattggtgttatcgacctgagcacacagacctgcaaggtcagcgttcagcggaatccaacggtacttgtcgttgtagacgtcgtactggagtttccagcccgagtccatgaccgcataggagcttgcgcgtccaacgaggttacgagtcgatacaacggcgttcactgcgtcagactgagtcttgttcaggacgtccgaaagctgcggcgagtagaacacaacgcagtcacgacgggattcagcaaggttgtcgattgcactctggacagtgacattgtgctcagtctcaccacctgcatcgccagtgaagatcaacgatacgtcgacttcttcctggttcgagaacagatcgtaagcgcgagtcaggtcacctgcagtgatagcagtcgaatccttaccgccggtcagcggagcagcctttacagcagccagtcgcttgtaggtagttggttcgcctgcaacaacacctggaacgccccaatcggatgcgtcagagatagttccaacaaccgcagttgccgtagcgccagttccgccaccacccgagaaggtgatcgtaggagccgaagcgtagccggaacctgcattggtaatggtcacgccagtcacagcacctgcagcaacagttgcggtacctgtagcgcgcacgccgccagccgatgggagcgagaatgaaacagttggagcagtcgtgtagccagtaccacctgcgccgacagttaccgaagcaaccgcgccagtcgaaggattggataggtctgcgccagttggcatcgacagcgcccaaacgtacttagaagtacggttcaggacgttgatgtagaagttaggaccgttgtttgcgtccttagcgtccgaagccttcgacagatacgagaaggtctcaagcaccgaaccaaccacaccggagaacttaccctgcttgtcgatgattacgacgtggagttcatcgttagcagcgccaagggattcagcccactgcgaggaacctggagcagtgtcgaacagatacgcatactgccagcctgcgaatgtcgcagcgtcagccatgtgaacagcgatcgagtcgccgagcgaacctgggaactttgcagcaaactgcacagtcgtaggagcagtcttaacgatctcaaagtgatttgagttctttacaaggaagccgttaccgtcatccgaagagttgattgcatcttcgtctgccgcacggacaatcttcaggtcgccagtgtaagcgaggaagttgaatgccgagaaccaagaaacgtagttcttgtcgtttggcttgtgataggtcttctcgagttccagcggagtagaaactgtcgcaatctgctcgaccggtccccacgcaaagtcacccgcaaatgcaccgcccgaggtgccagaagaaccaacaatgttggtgaggtcagtttcatcgaaaccaactccagggcttagattagatgatgccatctatattctcctgagatcaaaaatcgtgcttcatgtaagcaatatgtctgagatatttatgttctcaggttagtggaaagtctccaacaattcctcactctgcttgccaaagccgaagtcgaaaccatcgtcagtgccgtcgtccatgaatccgaaggctgtgtgatactcagcgtcctgaaggatgttctgtcgaaccagatcacgggtgttctgatcaaaagtatcttcgaagtaaggctgagcggagaaccatgcaaagattacgagtgacattacaatgtcgtcgtactttcccttctctgcctcatagcttgttcccttcttagagaacgagttgagttcctcgatcgtctcgtagtcgttgatgatgagctgattagactcaatcaaacccttgagagtagaacaaccaatctgcttggtcttcttagtcgtcttgacaccaggtgcaatgcgttcattacgagcgcctgagatcttcgcatcgttgtttccgccacgggagagaagcatgttctcatactcgtaatccatccacagggcatcaacaacctgcttaccgtaggtgtttgactccacgatcacgtagccatcgttgtacttcttacctgtcttatcaacaaggtcagcaagcagcaatggagacatgatgttcgatcgcatcatagcgacctgcttatatggcgcctcggtgacgtcaataaccgacacaactgagtagtccttaccaacaccttccgaaacgtcgacggtgatgacgtagaagtgtccaggaatcggatcttcatagatcttgaattccttatggtcgccaagcaaacgaataggattctggaagaccagtctctgaagggtgctaggcgagagcagcgtatcagacgaaccttggaactcgcacatgaattcctgattaaactgacgctcagacatgttgcgcatctgctcatcataccaagccttgtctcgcttaggatgttcgtgccagagcgcgtcgtcccagacatagttgttgtcaccacgtagagcctctgtccacaacttgtagaacaggttcataccgttaggggtagacgtgatgatgatcttggatgtatcacccgaagatacgaccggataggtagcagtgtagaactcgtggtcattatcaacccacgcgaactcgtcaaggtacagcaggttgacggacttaccacgaacacctgaaccaccggtagccgcagtcacaaccttcgacttgttacccagctggatcgaacccttgttccaggtatgaatgccaggctggaaccaccatggcagacactcgtacatttccttgatgcgatcaaggatttccatagcctgaccacgctgctgtgccagcacgtagatgttgtacttcttgttgaagattgcgtaccacaacaggacggctgctactgtcgtagtcttacccatctgtcgaggccaacgcaggattgagaatcggttgcctacaatcttcttcatcgctcggcgctgatagccgaatggaacaaatggaaccgtaccctggtcaaggctcagaatctctacgtaattttcaagaaaatactcgaagtcctgtgagcacttatacatttcctcagcctgctcaggagtgagctcgaccttaacgccagccttctttaggttgttgagaccattgtactggtcttgaggattgatcgtcccatgatatgtcttatcgaatttcatattgtttccaagtcttattgtccaatcacaggtaaatcatttaccatatgtctgtaagaatatttaccaattgtttctcaaaattagatcagaactagccgtcggctaagcgtagtcgcgacgtgagatagagtctgttgagtgttgtaccagagacaattcaaagagcctttacggcttaaagtttgaccagctctgctactttgcaactggtgtgttcatatgctcagagactgtgcggcatatggactggcgggattgcttaattgcaccaatcctgactaatagggcgccaccgattccccgtgtcctgtatagggtcagaccagtcttgtgattaaccccttaatcaccatttgagccagcttggccgaattgtgattaaaattcaaggttcagaaagacattatgaccactatgaggagactcgtcagagtctccgaattccgaacgaagtgaggatatgctccgaaggctcttctgagtccaatggattattgcgtctctaccgttgtgcattcgccttcgatgacggacgatgcttgagcagccttagcagcttccttcgcacgcttatccttctccatcatcatatccaagaactcttctgtagaaccaatgaagatgttcgtcgtagatccaggagcctgtacagcttcttcctgtggagagccgggaaccatacccttgcccttaggagcttgtttgatgtccttagacagcttagacaagttgatgttgagattggctgctgtgtttaacaggtttgccatcgcattgatcatcttgtctgactgagactgtcttgtgagctcaaccacctcaggtacatattccattacctgagtgatcagttccttcagattagatcgagcctcctgatagtcatcttcaatctcaggtgcttccttgaactcatcaaccttcgcaatttcttgtgatgggcgaggaatggtcgcaacaggagttgcggcacctagggattgtgagatagcatcaagagcgttcatcattacagcgttccgacgtgcttaccgttgtggtataggttatgcgcgatatgagagttcgggttattcttcttcaataggtcatggtgagcacgagcagctgcttctgatgcgtgagacttacgagcatcgtgcataccactttccttaccagacttgttcagagcatgagtgtgccactcatttcctgcctgagactgttcacgacgatgttttgcaaggtcgttatgtgcgtgcttccatcccttgatggcttcacctagaaattcttcaaatgtcattgttattcctcgaattgtgatccgtgcgtgtctacaatcgtatgaacctgattaggaccagcttcgattggtgtgactgtactcgtgtatttagagaagattctttcgtagtctttgtcaccaaagttaagaatggtctgcttaatcatgttggttgcacgacgatcaggatagtagtatcccttcacggtgaagttgagggtccacatgatcgtacgctttgtatcaaaggttccttcatattcgatattcagcgacgtcgagttcaatgtgacaggaaccacagtctcaagctggaagtcttctctatcacgaatggtcacagacagctcaggagtgaagaaaggaacgatctgttccagaaccttcagagaatcttctagcttgcgagcaccaatgtagagatcaaactggagatcataagggacacggttataggtcatcacctcttcaccgtcatccatctgatcgacaatctgattcagtgcgttgagtgctctttcaggagcatagttcataccgacaagctcaaagcccattcgagggaacgtgatgtcaatgtcagtctcgcccatactcttactggagtagatggcttcaatgaacttctctttctgtgagaaaatcagaggcaccatatatggacgaccgaagtcatctgtgacctgaatctggtcgaagatcgtagcgaatgccacgatcagctttttagttgtctgccaatagaagtgaggtcttgacattagaagtcaccccatgggttgtttcgatcaaactggtcaataatgatccctgtcttctcagagatgataccttcattgacacgagcaggagcctcactgtcctcagacacggtttccattgcatcaagtgcaggcttaccggtctggaacttctcacgagaaccagtccaggtttcgcaaaccagtttgtaagtgaagtggcgaccaaactgccagtcaggctggttgtaccatacctgattgatctcgaatagagtgttggtcagagagaagtcgggatcatatggattgccgacatagataaggtcaccttccattggacgctcacgaccagttccaagctcggcgaacctgcgcttggacatgatgaagtcagcagtctgattgactcggaagccaaacttggacatgatgttctgctcacctgggtaaccatatccatcaggctggtaagcttcaatgatgaagttgcgacggaagacagtcttcttcggctcctggaggatcggatcgacctcaaagatttcgcgaggaatgtagagaacgtcctgaccgttcatctggatcatctcaatgaccagatcctcgaagagttcctgttcggaattctcgttcgcagtgttgaagtagcggttcaaggccatgataggatctcgaagtgattaatgttcgagatatttaacctacgaagaaattcggcggctcttcatacatgtcgtggagttcttgtttcagcgtctgaatttcttccttcgcttcatccatgatctcctgagcgttcaactgaacaccaccaggtagctggacattggagaacttcacaaggttcataccccactgcttcttgatctgtgcagtagcatacttcttgagccagcggttgttccagacatcgccagaaacctcaggcatcacacgacgatagcactcaatgcccatccatgaacctacggtcagagcatcccaatcaccgaggatgtagagcttgtcgtagtgctgattgaactggattctatcctcagcagagaacgtatcgttcaaagtgttgaggtaagattgagtgatgtagtaagccgacagaccatcgccttgcatgatgcggcgaggattcatgatatctgtgatgtactgctgatattgcaggttgattgtagcgatgccgttaccgccaccgtccagacctgagcctgcattgatcactcgaagaacagactgagtctcaggcggaagctgaaggtaaccaagctgcttcatcgactcggtcacttgaactttcaggaacacgagttccgaaccgtctgagtgatactcccagaacaagtcaagggcgtcttcaattcggtcatcgacctgctgaggatcaacgttgatgcgcatcactggcgcaccaagtgctctcaaacagtagtttgtgaactcttctctcgagttgagcttagccatgtatctgttccagatgaattttcgattttatttaaagcgatgctgactcgatcaatgaggtcagaactgcactgctgttgctggacagcggtgatcgtctgtcgtaccgttgcttggtacgacattagacgaagggagatgtcatttagattgagcattttggagaagtccaatcagtgtgtctagcttagagtgaagcccccttacctcgctctctagattgtcgatgcgctttgcttgttttagacgtgccttagcgcggtggtactcgtcagtattggtgttaaccactcctgctccgcgcttgataaggtccggatagtcttttactcttgcgtccattatgtgattgcgattgctcttagcgattcaaagaggacaggcttggacgagttcttcgagcgaccaacaagtttgatcttgaaggcagtgaatggctcatcagcccagccggtgtagttgacgccttccgaggtgtatgcggtgcagtgctcagaagccacaaccttgtactcaaccatgtccgaagtgtcgaccgacgaacgcgacttggtcagagcgtttgccttgatccaaggacgtgcctcaatcgaacccgaagcgtagactggcagaaccttgaagtagacatcgaagtctgcattgagatctttataggcatcgacataaaggtagaggtcgtttgcagcgttctcgaggttgacagtacgagtgacatacttgtagatctcggaaccattgacaatctcttcctcggcatgccagacaggctgagatgcgtcgtatggaatcgaagtcatcttcgccttctcttgccactcggaacggttgctgatcaggatcgccgagaaggtgtccatgttaaccatcggagtgctggtcgcatctgtcgaattgaacgatgctgagacagtcaccgaacggttacctgtaccaagcatgatctgctcgttgtttgcagacgcaatcttcagaggctgaccaaggaacttgtcttcctgaggaacgaacgagattggagcctgagcctggtagttagcagcctcaaagatgcttcccgtatcgccatgacctacgcctgtcagagtccaagactccgaagaacggtatggcaggtatgcacctgagacgttgaacacgtcaaacttaccaccaccgttgtagcaaatgatgccgcttccgccaaagcgtccagtcatcgtagctggtgtggttaggttgatgatgaacgagtcaaccgagcatacttcaacaatcgagtgacccagagaacctgtgacgtgctcagtgttgaactcagacacagggatacctgcgatagtaccacctggatacttcgcaccgtacgagttggtcacaaccgtaccgaagcactggttgagtgtgtagctggctggcttcttagtgtcaatggagctaatcagataccagtcacgaacctcgcgagtctttgcatcgcaggagtaggtctgaccagcagtgaacacaccggagatatccttgagtgtcacttcatactgattggctgtagcggtcgacttgatgtctgagatgatgcccttacctgttgtggtgtgcatcgtctgaccaacctgcggaacgaagtccgagacattgatcgtgaacggtgtatcacttgtgaggctcagcgagatacgatcacctgtggtcagtccatgatcacgcaggaacacgcgcacgcgcgactggcctgtctgagtctggaacggattttcagggagaacgacttcctcatcttcatgagcattctcgaacacgaggttcatggtacccggagtgaagtttgccttgtagagacgatacttgatctgctcatactgctctgcattccaagtcgaaccattgagcgaacggaagctgacctcagtggtcgtctgctgctcaacaatcttacctggcatgttggtcacttcctcaccaaggcgcgagacccataggcgtgtgttaggcgaatagccaccaacaacgaagcagtactgagtcattgactcaaggaacacaggctgatcgaaaacaaccttgaatgccttgctcgaatcatcagacgcgaatggctggatttggtctggactgtagtacttctgtgcaatgacagttgtacctgggtagccgtttaccatgtcacggatctgtacgaacacgcggtcactgaacagatcaacctgcttgaagaacagatcgatcgaggtgatgaacatgtcgttgtctacaatgaacgcctgtgcgataggatcaccacacgcacctgccgttccaccaccagcaatacactggcagatttcacgatagttggtagggtgatacttcttctgatggttaagacatgctggatctggagcaggcggtgctggtgctggctcaggagcagcacgtgcaggattgactgtctcaggaatgacgattgtcgaaacgacattcagtgtgacgttctgtttcgtgacgttgacaccgccagcgaaataggctgccttagcactggtagtctgcatgtccgggtcgccagtgaggcctgggtcgtccgaaagaacaaactccttctcaccggtgaagaatcgaccgcctgggattttgaactcaccacggagctcaccgttagcgtcagtgataagaggcgaaccaaactcaacaagctgcgaggcggttccagcattagcagcgctaagctggaaaccaatgtctcggcagaactccgaaacgggctgaccgtcgaagaacgcatagacacgcgtgtttggcttcatctttgtagcataaaactcaacgcttcggctacggatgtaagggacgatctggacgtccttgactacgtcgcccagatcgtatttgtcggttctcgattctacagttgccatttctagccttaattagttagcctgggtgaagacatttaggttgcgccacggcgaaccaccacgtccaccaccgcctgtgactggtttagtctctgtcttatttaggacagtagtattgaggtcgacgtgcgtaccccagtcaacagccaggaccttctcttcaacaactgggtttggagcaggatttggagtctgttcaacaatggtcttgatcgcttcaacattagcatcgatgttggtgatgagctgaggaagcatcgtagtatcagaccaggtgtcgttgtttggcgacattgccatctgaccttcctgattgtactgcaggtaagggttgacactcagatgcttagtagcatatggctgctcaactgcaacgctctcagtgaacggtaggtgcgccatgttgcctgacagctggaagcctgacgacttagctgcgttgaacacgagcttacggttcatcaacttgaagcttggacgcagctgggccttggtacggtcagcagctgccttgaactccgtgttggtgagatcagctgcctggaagtcagagaagttgtctgcaatcaaaccattcttgaatcggtcaaggccattagcgtccttgatggacatgtcttgtgccgacttctcgagaagagtcagagtggtgtaatactcaacgttctcgattctcttctcgagcgaaccaatatcacgcatcgtatagcgacggttctcaatgaacttggttcggatgtcgttcaacgagtaggtgtaaggcgacagccagatctcgtagagagccattgcattgtcgtcagtcttcggtggacgtggatcatccgaaggctcacccttcttaacgtagatgtaaccatccttgttgatctggagaaggtcagtacgtgccaggtagtattcgatatcaaagatagcggtactatcgttggcaggcagaacagcatttactgggtttgttccaaggatatctggacggaagtcgatggaagcagacagaggataaacaacaccagtcgtagcagtgtatccaccaagagtctcatatgtcacccctgagtcgtcagcgttgagggctggagcataggagtcaacagtgaagaagccctgcgaaccgctgtgctcgaagtaatcgaagttgattgcaaggcggtacgagttgttcgccgagaagcttgcagccttcgtacgaaccagcttggactcgcggtatgcggtgtcagtgatgttaggattgatcttgtattcgtcagtgatgtctgcaactggagtttctggcgagccttcgacgaacagcttgacgctcttcagacgatacgcgtcagtcacaccaaggacgatttctgcaccaatagtagcatcaggtggcgtgtttgtcgtaacagttagattctgaggcgttttcgtgcgctctgtctggtttgttttcaacacgtcaatgatcacatataccgatgcaccggcggcacctgaaccgagcgctacggtaatgctagttgggctgaacgtggttagcggacctgggactacggaggttgtcacaccaccagcaacataccatgcgagcatggtcgaaccagcgttgtcgaaatattcgttagccgaagtcgtgaaggttaccgaacccgaaccgtccgcaacaccattgagctttctgcgaacgacaacattcattgcaccgttgagcgggtcatcggaggatcgaagtgacttgacgttctgacgatcgatcttgtagatcagaggagtctgattcgcattgtagagttcaacagagcctgtgacagaatcaacaaccgcgttggtgtagaagccagagcttgcaaccacaaaggagcgagcatcagacagcttcttgcctgggttcagagcaatgtcatagacatagtaacggtatgtagcgttcttggtagacaggttacctgagacataagcagcatcgctgatcttcagggtaccaattggtgcacctgcggcagcattacctgtggttggctgatcgtagatgacgacagttgcatctgtcatcatacctgcgttgtttgcaccagcccagatacctgcacccttcggaacgccgaggatgtagctgcgtccatcgaagtgcttaacgaacgaagacatcttgttcgtatcacgtgccttcttgaacacgacaggggtatcggagattgtctctacacggtaacccttgacatatgcaacggatggagtgacaactgagaccagcgagtcttcatcaccgtcaacagaccagccaagcgagtcggttgcagatgatttcttagcattgaagaaggagaccttgaacggacggatggtgtaatcaccatttgtctcataggtacgcttcgcgatggtatccatcaggtcagcatactcagagtcagtcttcatgaactcaacggtcatgccagggccaaggcggcacagcgggatgaagttttcaccatcctcaaagttgtagctacgcttggtcaatacgagcttagcctggtaacgatcggcacctggagcagtgctgtttggataacccagcgatgggtcaagcagcgagctgtcttcctgataggtgacgatgttctgaacaaagtccagaccaatcttgcaaggaacaaagttgacgatgtctccgccagcattcttctcgaggtacttgaccacgatgatgtcttggcgagtagtatcgaggaacattccctcgaagtagaagataccttcgtctacagtgaagaactgaccccagcctgttggaggcagagtgtcgctcagaccggaacctgggcaagatgggcagcgaacagttacagtaccaacctcaacgctgttcgagtcgaggattcggatgttctcacccgggatgaatactgaggtttcgccgtcaactgcggtacctgtgtagacgacataaagagttgccggatcgtcgccttcgacgtcaacaccacgaacaagagttgcggtgatgcctgaggtctcaccaagaaggcgagtgttctcaggataggtagacacaacaggcgtaccaatcagtcggacataagccttcgactgcaaggaggtacgcgcattgctgaccttcgaaccattcttgaagatatggttggcgaaggattcaatctgatgttggaagatactctgtacctgattcagttctcgagcctgaacaggacgcccaggctgatacaggaccttcatgaagtttttcttcggctcgaaatcgtcgaagtatggagcacgatttaggtcaagcttggccattggttaccttaaagcgaaattgagatcttgatcacttcttcctgcgaggaagtgtgttcgatagctacgatgttgttcatgtacagaacaaaaccgctgcccttgagatatttagcctgcgatcctgaaacaaaatctggatgcgacggtccgatgtaggcgagtgcgttctttgtcgttccgcgaacgcccgaaaccagagttacctgacggaacgaaccgtcggtatctgtaggctcagttgggatatatccagacaggcttgcagacagacgagccgaaatgagaacagatgcgatgccaagctcagtatcaagattggaaccgtgaccgcccggaggagataggttagccttagcaacgccaccagatgcacctgggatgatgaacgccttagcccaggtgtaaccgctaccagcctcagtgatgttcaccgctgtgatgatgcccgaggaaacaacgacagttgcttcagcacctgtaccgtcaccgatgatcacaaccgatgccgaagtgtaagccgaacctggagagctgaccgtcagtgtatcaaccttgcctgcagcaagtgtcagagcaagagtagcacctgtacctggagtaccgtccttataggcgatagcataggcttcggtatagttagaaccgccggcggtagcatacagaccggtcagcgtcttagatgcacctgaagttgtcgaacgtgctgcaccagatgcgccagtaccgttaccctgaacaacgacacgaatcgtgtctgtagatgcaaacggcgtcgaagtcgaaaccatatcagtgaaggacgagatctctccctgaacagtggtcacgttgacttcggttggagcaggaacaaattcggttgtgccgaaagtgaacatctcaggacctgagaccgaaccgacatacttccaaatgtagccatccgcagtctcgatcagagaggtgcttgttccagttggtgcatctgtcgatgctacgccattgttgttatcgaggcacttgtagacataggtgccgccaacgatagcataattcggagtggaataggtaaccacgtccggatcatactgagaatagattgtgccagttgtccaggtgttgttcttcagacccagacggaggttggacgagtcgatcttgataagagcagtgaggtcatcaagtgcctcattctgtcctgtcagagatgtatctggtgcgtccggagtagatgggttcgcccattctgtctgcttaccaacaccgaggtagatgtttgagatgacgtcgccatcttgaacattgtctgcaccaagtgcaagccagcgcaccgtgccgtcatagacagcgccagtggtattggatggaccgttaccggcacctgtgacaccttcctgcatacagatataacggttgttgccgttggatacctgtgcgcctagcgagtaggaagtcgaaggagttctagctgatggacgaacagacttcatagcctcgtacaagctggagatcacatatggtttgatagcaggcgtgaagctgtatgccatttcttagatcctcaatcaattaggattggttcaaataggttggtgccgatttcgtcaccggtgtctgttacgagtgtgattgtctcaaacgattcatactcagacacaaacgtcaggtttagaactgccggatacacgattggagtttcggtaccaatcgcaggagttccacttgtgatatttaagccaaggttagaaacaatctcatatgagcttgagcgaatgaagccaactggatgcagatagtctgcaacaaagctgtcgtagaggctcgaagagatagggctcacaatggtgtaggagaactgctgaacacgatcagagtcaatcagtgttgagctctcagccaggaagccttttcggtcagtccagtcacgagtttcccaacggctgactgccttagcggtcatggtgccgcccgaaccttcagagcttacgatagtgatatcggtctcatcgaagtctacaaacgggttctccattttgacagtttggatcgcgcccacgttaccacccgacgccttaaggctcgctgggacagcactctgagcataaagattaggaagtgttgcgtagttgtagccttcattgatgatcctgtaacccgtgattccaccctggtcgttcacctgagtcacttcggctgagaagccaaagccatcgtcatcggaacgtgctacgatcaggtcgcctacagagtagttagcgcctgttgcgataatctgaatgctactcacgccacccttacgagtgctctcgatgtaagcattgccgttgagcttagcgccagtgatttgaacaacctcacctgccttgtagcctgaacctggagtgccgacttcaattgctagaacaggcttgacaaactctgtgatagcaaaatcgccagacacaatggtgacagcttcgccaacaagaaactcaaatgttggacggagaatctcgattcggaaatacggtgtacccgaaccatggacgatctgaatgttctcaattgacgccttgaccttagtggtcaaacccgtcaacgtaccgccattctcgcgcacatgaagtacgagatcctggaagtcaagcatgttgatgttgttcgctgaggtgaagatgaaatgacgttcaccatactcagcataggatggaaccaacatctgttcacgtgggtagcgaatttcgacgtcggcgttgaaaagcatacggaacaggaatcggaacgatgcctcagtgcctcggctcagatagaagtcctgcaaaagatgaatcagcaggttcttatctacagctaggttctgccctgaaacaaatccaaggtctgtgagcatcgcatcaatgtacggctcgaccttgagcgaaggctccatgttttccttccaggcattaatgatgcccaagaagttgtcgtcctgttccatccaggccagatagtctcgcacatattgtacgaaatttggatagttctcacgcacaaactctgggagcttatgcgtgagtaccggaattagtgtgctcatccagcggctaccttagtggtttcgatacgaacgatgttgttcaagttggtgttgatgtctggcaccgcaggaactgcacggaactccagaacaccagatgtgcttgtctcatagcctgaaaccttagcagcctgaggcagtgcataggtaacgacacctgaaacataatcaaccgtgcctgagttggcgacgatcactgagctatcagcaacacgaaccaacttaagaacgcctgcggcgtcatcaatcagcttgacagtctcagtaccataggtgatcacacctgattcgattgttcccttgactagacggttaccaaacacaaccttgttcgaagcagtcgagttgtgcaggtgctggtggtccttagataggatctttgaggaataaatcgaaacaatggcaggctcaccctgacgaatgtaagacaggagatcgacgtcggaaaggatgctatcaaacttggacaggtaggtctcgttgtattccttgacacgatcaagaatcaggttgaacagttcaggctgcgaacgagtagtcttacggagatcaagcttagcagtaatcgagaggtcaatgttgatgaagtctgggtcaacgaacactacgtccattccgaccacaccatacttcttcacaatgtcctgacgaatctgtgtgcggctaagtgcagtcaacttgtccgagttcttaggcttgatcgagacatagactttaccgtaatctcggatcacgttctcttcaccgccccagacgttgagtgaatcaacattgcggaacttgtcaagcaggatgctacggtagtcagacgagatgacgattctgttctgacgcttgttggcgttcggaatagcgaatcgaaggtcctcaatcgactgaggttccataccaccagccgaaatcgagttagtcgttacagtcgagactgtgttctggaagtcattctggaatgtgaatacctttgcgccgttaccggtctcaccgtttgtgctgatgtagctcagttcaacagcgttgccgttttcaggctgaacaccgaacacgccattaccaaagaagatctggtagtaaccgttctcatctgtcgagacaaagaataccttagatgtcggatcaaggtcaagcacatctgatgcgatcgtgtactcatcgtagactgtcgacgatgcattttccttcacgcgcacgcggaacgtatctacgtcagccatttcatccttgagaatgaaacgctggttctggacactcgtgtcaactacaaagttccaagagcggaactgaccttcatagatgcgcagaggtgctgaggtataggttgcagtcgagcctgtaaccgaacggttgtagatagtcgtaccgtcaaggacagtaaagatacgctgatcttgtgtgtcgtttgttgccttgaaagtcgtaccacgttcaataggatagtttcggcttagtggctcgttgtctgtaccaactgtgagcgtaagaacaacctcagcctttgcagactgcttacccttcgggacataggaggtcttcttagcatggcttagcattgcctgacgagtgtgcgccgagtcaatgaatgcctcatcaaggagcatcttgacgaagaagccgatgtagtgagtttggtaagacgcgacgttgagcagcgtgctgataccggatgcttcaaagttgaagtcggaatagcgatcgtttcccttcaagaactccttgaagttagtcttgatgtcttcgaattgaagagactggacaggcaagtttttcatcggattctctcgacaatcaggttaaacgagtcgatggtattgatcgacttgatcttataggttacggtaatgtcaaagccatctttgttcttaggcgcgacgatatcaatcgactgaacctcgatgcgaggctcaaccttggtcattagccatcggatatctgtctcgagagccgcgcgtgtgagctgcgtgttctgctcgaacagatagtgcttcaggctagacttgattgagttgttgaatggaatgtcataggcattcaactgaaaggcgtgccttacagctcgtttgattgcctcttgatttaccttaggcatgaggtcacccgtatgtggattcgggatcaggttcaagtctaggtcggaaaagattttgttctcagccattagcctgccaatactgtcattgcgcctgtcatcaagatcgaaccgcagttggcagaatcaccaacacgcataagcggaagaccgttgacaaagacggtggaggaacccatcattgcgaagctcggatggcagtgatcgcagcagtgtggctggattgcatcactgactctgtgagcaggcaaaccttcgatgaacaccgtaggtgaaccttgtaagaccttctggggtggatagcatccatgtcccatggtcatatctgacattcggcaagttggtagtcccatatcttgaatatttacctacagccctttggaccgttgttaagatcgcaatagaattgtgtcgccattgctttgagtgcatccttcaagcaataggtgatcacttcttgcgttgtgatggttggaagtagagaaggcttctcaggctcctctggacaagggcaaagcgtgtcgggtagcttaggagtcggaatgaacggatcgactactgggcacggttcgcatagctcaggtaatgttgacactgaacgtttctcctccgtagccaattggtgtggttggtagcgactggttcatgtagtcacgccattgagccatcaacactgcaaggttgtttggatccattgtaggatcaagacgaatctcagcaagttggagatagttctgatagttggatgctacagcgtactcaagcgcctcattagggttggtctctcgatagtttgtgatgatcttgaaaacttgtgagtctctcaaatcatctcggaacttctcgagatatgggttggtgaagacagtgtccttgttgaggtcataccaggtgacgatgtcgtttggttcaatgcctgcaagctctacagggattgcgatcagttcaacctgattggcaaccgttgagttctggcatggttcacagacagcatcaattggttgaggaatgaattgcgtttcctccatcttagagcaaggcgcgcactcgacttcaagaggcttcggtggctctacgacacggacataatccactctttggaatgggctctgctccatgaagttgtctaggtcaaatgtccagttgttgtggatcttgacacagaaccaatcttcatcgaatgcggtttccttcaggccatcaacccataccttcaccttgaagcgccactgacgaccccaaggccatgacgttccatcgttgtcggtgaaataccagttcacagcaggtgcaggcgaatcctcaaggcagtcgaggttaggcaaaagacctgtgatggtaccttggaaatccatctggagacccggaggaagctcgccttcgaggacctcgaaatacagagcctctttacactctctaggagggcgcggcggatcagacacgatgcatgagtactcttcccctgcgaacatatcaacaacaagattcgctgtctgcgaatagcctgtgaacgatgcagtgaacgaacctgattgtggagttgcagtgccagggcgaagacagatgatgtaatcgccaattggaaaatcaatggtaacgctgacaaacgcagatgtgatagacgccgaaccaattggtgttgcagttgcaccgttccaactgaacaccgtcatctgtgtgttccatgaatttcctgcaaggttgaatgcaaattgaacagactggaactgaggcgaacggagcctaaacagcttgttagccgtcgacgtcacgctgaaaggcatgacagtgttagggaagatctcttgtagagatccaatccctcccattcctgcaattgattcaagacatgtagccatttgtaaagttttcttttattactggttacttactaaagaaatcttagaagcatctagccttgattgagtgagtgaagaagtcaagctcaaccggaacaggattgaacttgtcccaatcagggtcaccattctcgttcgaagggacatactcgttgtccaggcaacctacttcaaggaactcaacgtcgtagtctgttgacaggttgaccgaaacaaactcacctgctgcgccgtagatgtccgcttcctcgaacttagcaccaaccatctcgccaccgaataggctgatcgagaattctggattcgatacacgtacatatggaccttcccagaagttgatgatccaagcatccgcaatggtgacgatcgcatcgaggttttcacctgttggcattggaacctggaactggacattgttttgaatgtcaaggtcaacaaatccgccgtcaaagatgagagttgagtcattgcagagcgagtcggttgcaacaagttcaacattgacgtgatcaccatctggaaggaagttaccctcacacaggttgaagtcgtaacggttgtactcgacacgatcaacaattgcgcctgagccttcatagaagttgaacgtcaggtattcaggatcaaccgtgtcgaagcgctcaccactgtagacgttgaggctgaaacgaggcagagtagacagttcagcagtgaagacagtcttgtcaccgtcgtaacgctcatctggtgctggacctgcggtcagttcgattcgtgccgggttgtccttaattgggcagcaagcggtgttgttgagatcgacccccatgaaaccgaggatgtcatagttgaacgagtgaccatccttgatctcatttggatacagcagtacctgtggcagcgtagtgaacgacgtgatgatgttcgcgccgtcatagatgccaagagtaccaatgccctgagaaggacgagtatccaggatagcggatacgttctcgccgccataaccatccataggcatggtggtctcagtcgagaatgtaacctcgaccgatgcaccatcatagatatagtagttctcgagtgtatcaagaccaaccgaaaccgatgcaccatcgaacataccgaccgtgccaatctgcagagcagttgacagatcaaacgatgccgatgcgccttccgccatcgcaaacaggaggtctgcagatgggttgatcttgatatcaaagtcaaacacaccgccatcgtatgcaacaggctgcaggacggaagttgtgctgagggccaggtcaaccgaaccaccgtcatagacgttgatcgggaatgttacgaccgggcgagtatcaagaactgtggagaggtatgcaccatcctcgaagttgttgattggcaggattgtcgaagtggacagatcaagcgcaaccgatgcaccatcgaagaagctagctgcgatgttgaagttagtcgcaggataggttgtcagcagaccatcggtacagccttgcatgttcgcaaggtcgatgtacgatgctgggttggcgtagttacgatagtaccaaactggaacaatcgtgtttggccatgcaagattcgtgttctgtgcggaaagaagctgttcgccgtagtaaatctcaaggcgaatgcttgaaccgtttttggtgaagcgagcacggacacgcgcgccatttgcataaaggtcgagaccttcaggcttctcaaatggctgcaggtagattgtatcgttaccaattcgcgcaacaacctggacagtctggcgaccagtgtctcttggcagctggaatttcagccaaggcgcggtgttgatgttgtacggtgtagcgtattcccagtagcccgttgcagtcgtaatgctcgagtgcgggcggttgaagaacacgccgaactcgaggaatgcatctgtgctatcgttatcgtaccatggaccgcttagagtctgtgtccatgaatactcaaatgaatcttgtcccgatgtatcaacaagcggagtaccgaccgaagaacctacggttgggtcaccactgttctgaaggcgaacagagttgagtgttgggtttggagccgcgtttccgctcgaaccaatgttgacaaggccagtgacgttctggcaaccctgaccaccgatccaggtcgcaccatcatagaagttgagaggcagaccaacgcgggttgtcagctcaacaggagcaacggaagcaccgtcgaagaagttgagcggcaaatagccgtcatacatcttgacctggagttcgccaccttcacgcgcttcgatgaagccttcaaagtcagagtagcgaatacctgaggacgcgcatcggaactcaattgggatgcggttacctggatatgcctcagcgatgttatcgaacgtaatcgggatgcgattcgttgcaccctgatatgtccagttagaacagatcgaagggaatagctgagggataccgaagttgacagtagacgcgataccttcaggctttacagcacgttgcacacgcgcattacccattgcactgtcaacgaatgcaataggagcgattgtctgagagtcagcaggtgggcgccatagagcatggatgacgccatttgtaggattgaagtactcgtccttaccagcccatgaaccgtcaagtgtccaaattggcggagcatactcgtaccaatgcaggacgtagttattaccaaattgggttgagacccaacctgaaggtaggatgttctgctcggggatgatcttagcatcaccgaaggtgagcgtcgattcaatacctagaggagagatgacgatttgttcggaccacgatgcaccgaccgcagtgactggagcagagtaagacttagctccgaaccaggttgtgtctagcttcccgccagttgggcggatgtattttgagccaggcttagtctgtacaacgccaaagtcagattggtcaagacctgcaggcttgatgaattgctgttggacaattacaggaacgctgacaacggtctggcgatcaatgcctgcgccaatgtatgtcttgtctccccacgaaggtgagactacatgcgcaggctgtccatagacaggcttaccgttccatgaaacctgaaggaattgacccgacaagtgtcctgcaaaactaaaggttgcatcattactaatctcgataccaaagatagtactttccgggcttacaatgtccagagttcccacaggtttggtgtgagttagattagacgcaatgaaatcaagtggcatcgctgctacctgcggcgtcgtttagattttcagatagcgcgttcaacacagataagatatcagccctatagactgagatatttaaccgtgttttcagatagtgaaaggcgccgtcggggcagggaaacttgcaacaccttggtatcgtgcaatgttgctcactcttacttcgccgactcttccattgatgtatcgaacgacgtttgcaactcgccctgttcctacgtaggtattggcagtagtaacaggtgccatccagtagccagctgtaagagtcccagacgcaacctgggttccatttaggtagagatatgtattagttccaaatctttcaaaagcaatgtgataccaagtattaacttggagcaagtttcctgctgaggaaaggcttgatgtggtgacaggagatgcgccaccaccctgacctgcattgacatatccttcgatgccgtttgcagaagttgggccaatctgcaaacggttattgttgtttgcgaggtcaccgatataaaggacacattgcgacgatggctgagaaagtgcgttcatatagaaccatccttcaactgtccaatctccggagccaggcgaaattgcaggatagtatgaaccacccgtggaaccgtcaaagttgatagaattttcacctgcaaacttgccgctagctagtgtatagcctccaagcatgtacgaataagcatttgtgacttcatccctcggttgcaattcgtgatttcgagtgaggaaaattgtgttcacgtccacatcaggatcagctacttggaatggtccacgagaaattggtgtctcgaccagaccaccatcaacccatgcagctgttccgtcagtgaagctagtaaccgatgaaaggttgaggctattggtattcggagtggtgagagcaccatcacctacaaggtaaagagatccgggcgggaacttgtaatcgaactgtcggcttccgccagacccagtcatggtccaggtgatacctttggcgtcgttgatgttgtcgttgaactgtagaagagatgagacgttgttatacgacggatctccatctactcttggataggcagaagcaggtacggtgaaggatgtcttgtatcgagctgcacgagtgaatcggaactcgtcgatccaacctgtcaggccatcgtttgtgtttggcgaataggtgaagttgccaaggcaaacctgcatggtaggtgatgttggaatctgagatccggtataagcaccaacaaggtttccgttcaagaacatgcgaacgccgtcggacgttcttaccaatgcaacatggtaccatgtattgggtgagataggtacagtgactctgggcgcaccagaaccgccaaactcagaatagaacgtcaggttaccttggttgtctcggaagacgttgactcggttacctgcgttgatactgatctcgaaaatgtgaggcgtgacattggaaccatctaagcggaagaatgtctcagccgtccaatctccatttaggttgtagtcggcactctcagcaagtctgagataggaacccaccgaacctgtgaagtatgctgatgaaccaccaaacttagattggtcagtcttgatcactgctccagagttgatccaggttgcacccttttcatcttggaagactgttgcaccatcggtactgtcaaagcgagacagaatctttgtctcattccaaagaggatctaccggaccgtatgtcaggaagtcttgtgtaggtacggtgaaggagttacctgagtagcgagccacacccttagtgattcggatgctatcaaggtaaccttcgaagaagtttgcaagagaaccggtgcccttatctgcaccgatgacgacatcgtatgtgtttggagcgatagtcagattagcttgctgagcgcggatggttccatcaacgtagatgctcagagtgccaccagacattacccatgcaacgtgataccaaacgctcgtggtagtcgcattggtagcggaaaggtattcggttccattgaccatgaagccaaccgcaccacctcgagtgatacatgcaaagccttggttagattcaccaagcttagagatcaaagaggcattgctgttagctgcctttttcatccaacattcaatcgtgaagtcgccgcccgaagcccagttaggttcgacagttcctgaggtacccgcagtagcacaggtataccaatgtcggttaggagtctttggcaggatcttttgtccaacagtataggctgtcgaaggtagccaagtcgaaccgtaatcagaagtcgccacaccaaacacatgagcgccgcgcgccttcaatccatagacagagtaagaaccatctgttgcacttgtggttttccccatgagttcaggcgtcaaaccattcccgtaagagaatagcgagatatctttttggcgtgcgacaccatcgacattgacagtgccattcacggttacaaagtttcttggcattaggctaccgctgcaggagtggtacgtgcatagaacaggtcgttcaggagttcgccattgttggtgatgaactgaacatcatatgcctcagtgtctgaggttggagtgataatggtatagttaccagttgtagcatctgaggttgtctcagcaaccagaagtccgtctgagcggcgatatgcgcgaatcttacgagcagctgggttgttattgacgtctcgaaccgtacctgtgatggtacctgtcttggcattgataacgatgaaggaagtgattgttcctgaagaacttcctgcaactaacgactttggagcagaaaccattggttcttcggcgtaggttgtgccgttgaatctacggaagttgtctgttgtgtaggtgttagagccttgataggtatagatcttattgaacttgctatcatatgctgcccaatacaaatattcgttgctacctgaaggcacttccgtaatcgtgtttgcaacagtatctacttcaaagagataagaaacattagattgtgtgcaggttgtcatcatgaccgaacctggctttgtccagtggtcaaatcccttcacagcaccataaccatactgatatccaccaacataagaagttgtgtgcgagtatctggagtttgtgctgattgttgttcttgttgcaagattaggtgtccactttgtcacaaaaggagtattagccgaaacagacacaagcgttgtcccatcaggtgtccacttgcaggtcgagtagttcagatgagctgatgcagcatcaatataggttccatctctgagatcatagattcggaggaacggagtagtaccgtgagtaattgcgaggttgtatccattaggatgcagagagcaactatagatttcaccgagaccagtctttggaagagtaataaggctattgtctgcccaacggaatgcgttgatataagaagtcgatgatcctacccaaccatagtaatcgttgccacaaaacgcgtcattgatgaaccctgcgtatgctgctgtggcattggtcgaagtcaagcctgttgtagttacagtaaagtaacgatgtacatctacagaagtgttagaatgtgagaagatgcccttagcctgatccggagacagcttgatcaaagaacgatattctgagttgtaaccgttccaggtaatgtcgatcgttggatcgataattggctctagaccctgacgaagcatgaaagctctgccacggtaagggaagactgcatatggctggtaaacgattagatgattcatagacggaagattttgttcgtaccattgtcccaaacgacgttgatgtcaccgctgtttggcgttactggaagaccggatgcaatgtcaatgtaggcgatcagaggagatgtagcttcagtgcctgtgtctttgtagagcacgaccgcctcgatacttgcgcctgagaccgtagggaagacagcgtcagccgcgtcggctgcaccgtcagttgtagtcttggctgtcagagtgatcggtcctgcgacacgtgcacctgagggaatcgaggtaacaaactcatgcgtagccaggttgactgtgtagttgcccgagtcaacgagtagagcacgaatcgtgtctgtgttccaattgattgcgccttcaagaaagcgctgacgtgccttagcgtatagtgagtttgccattgttgtttctctttagttcgtcttatttagacaggatcgatatacacccagacttcgtctgtaccaccgatctggctaccgtccttaccataggtacatctgatcacatcgccttggttgacaggagcagtataggtgaaggtttgaccaacaccgcttacacgtgccttttcgacattgttgatgtacagatagaaaatgtcatatccattctctgaagatgagtacatttcaaatctgaggttcgagtaatacttgtcagcagtccaagacgatgaggtagtttcattgttaccaatcaggtttgatctcagtcttggacgacctgttgtatcgttctctaaaatccaacttccaacaaatctcgagacgatcggtgtctcagctttttcaatgccaccttcagcaaagagacctgaggaatcttgaactttgaaatacagagtttcttcaagaggcgctgtcacttcgactgtcaagaatcgtccatccaaagtgatagatgaccctgtaggtgcaaccgtgtctgagcttagttggtaaggcaacacacctccggttacctcaaagactcgcttgaaaacaggaacagagaacgagttagggaagccaggaccatgcagatacatctgatggtcagtccatgggcgaatcttggaaaggatgatgtcgttatagactccgtcttccttttctcttgcaacgagatcaaccaacagattaggattgagatcgttgatcatgtaggttccgttcacaggactagatacggtgcttgcaaagatctcttttcgaccttcacggaaatgcagctcaattgttcttgatgcaggtgagccatcaaccgtaacaatgcccgggagcatacctgcaatgtaaccaagaccaccaagttcttttgagcgctttcttacctcaccgtctaggaccatgtaatgatctgtcctgtccttccaggtataggttccaatcttcttgaattgtgctgcttcaagcaggattgacattaccagtctccgagaaggatgtagacaccttgggtcgtgttgttcgtaactgcaaattgaataaggtcaggtccggttggattgttcggaagctttccgtagttctcattccatgtcaatgtagaacgaccaaccaaaccgtagagaccacgccacttgccagtgatgttagtctggattgcattctctaccaggtatgccggatagaagatacgctgacctgtgtagactgagaagggatggtgctgatagtaacctgatggccagctacccgccatgtagtgcacccatgccttagagaacttgtctgcgacattgtcctgtgcacgaccaatcgcacatgcaacgtaggagctctgatcatcgatcatgcaaggaccgttcgaggaatagccaccatcatactgacctgctacgaagtagttatgaacaaagctaggaacgaatgtctcataatcaccggcaccgtacatgtatccatagttgacatagctgttcgcagcctgactcgaccatgggcaaacattcaggtagaacgttctctcatcgccgatgaaattccacatgattggattggtgttctgcgaagccgacttaggccaatagatattggcgttggaatagcttggtagcgttccaggaacaccatcagtgccagtagacgcatcgttcatggtcttgtatgctttgaccatcgcatactgccagttagagtcatctactcgcaggtacatgccagtcgaacctgcagcagtcgtagagttgcggaacactgcaacgttgcctgtctcgaactctagcgtccaacccatacctggcttggagccatatccgttgacaagaacagctttcaggactgtgatgaaggcgccaggtgttccgctaagaacaggagcgtcggtatcggtgtagaggtactgggtaactgccattatggaacatcctcataaagagctggtgcaatcggtccatagacacgatagcgaatgtttggatcttgtttgttcatgaccatcaggtcaatcaaagagttgtcatacaatgtcatggagtagtcgcccgaagaggtcgaggattcgatctcacgaagcagggcgcctgttctatggctgaaggcgcgcacagtagcacgatatggattaccttgcagtgtgacattaccttgaatgcgatagatcaacgaatacatgttacgtagacggatctcggcatcatccagcgcataaggatagacacctaccgcagacatatagccagtggtatttagactgcctggagcagcgcccatcaagtagacctgacctggacctggagtagacagactatgaacaggcgcagtcaccgaaccgtgcttgataccgtcgatccagagggtgacagtgctccccttacgaactgctgcaacgtggtggaatcgaccatcattgaaattgaaaggctgaccattgtctcgattcagcaaagaggaaacaaagtattcctgactcaccgatagctggacatgtcctggcacgttggtgttgttacggcgattcacttcaatcagaacaccgccatgagggtagtcgtcgcgctgacaggagaatagaactgatctgtccgtgttcgagaactgcatccaaaggtcaaccgtccagtcgccattgaagttgaaaactggcgtataggtcgagaggttcgttagcctatgcgcagcagccataccaccattgtggaagtagacagatgagccaccaagaataggacttggagcagtctgctgtcgtgctactcgtgtcacgccacctagatacgttccgtcattgtagcctaccaaatccttcatcacgaagactgccggatcttccacgtctgtcattggccagtaagccgatgcctgagcttgcactgcgatgttgtcatacgacttagattttcgatacaagcgacagatttcgtcctgggtcaacgctttgttgaggatgaacatctgatcgagttgcaggtcgctcgtctgacggtcttcgaagtatgatgaagagttgattacgccagcgatctcgattggcgtagtagttgtgcttgatgggaaagtgccagccgtagttgtcgaatagctgccatacagatggccgttgacgtacaggtaggcctcgttgaggtagacgtcaggattgatttccgtgatcttccaagtgcagacaatgaagttcttcttgctatagaaccaatcaggcacaacccagacaatctcaccgccaccagggtaaccgaaacgaatctcttcggcagctgaccaatagtcacggaagtagacgtcgaacgacccagccttacggatgaagcgcttgttgagtgtctgagtataggtgttgccaaggattcgttcctgatcgcgccacttgtcttccttctctgccttgttgacaaagaagccaacagtgtaggaacctcgctcttcagtcagagcaagatgagactggtgctgcacttcaacgaaagattttggccaacgagtaggcgcaagcggctgatagccataccaaccgaatgatgtgctacgttgatctgtctgctcaatgtcaatcagagaagggatacccatgcgataggctgggtagagttctgactcattgtgcaacatgatgttggagttgaaccccgactcgtcaatgaagacctgcgggattgccgtgagcgttctgctgttcggatcgtacgcatctccatcgaaggtaagaaacatcttcggcgcgtgcgaaattactgtctgtttaaagcctgccattacaaagtccttggaggtacacgaatatttaccacggttgttctttcgtaggtgaactgtagcattgtgaacatgaacagaacacgccaagaaaagattgagtacctcgccgacgctctgctcgaagcccaaggcaaagaccagtgcgatttttctgaagaagcgaaagctattctcgacgagatctttccaccactgcccaaggtagcgtacgacaaggcgtacgaccgctacttcattccgttcaccctgaccggcgccgaagtccagaccaagggtcacggcagttcgttccgcattcataacggtgaagaccgtcgtctttctttccaggactacggcggtgagcacgaatttctgaccaagctggcgcgtcagatccgcctggagtacggcgaatgatcctggcaaagtgggcgctcgttctggtgatgtctacctcctgttacggtagcggttgtgctccaggcatcactgtcacctcgatcccggtagagtcgaaagaactctgccttcagcaagccaactacctggcagcagaagcacgaaaggtaactctggataacgctttcagtcagactacgacaaaggcaatgtgcatccaggtagcaagatgaacttcgtgacatatcagctggcgatggcagtgagaagtgctgtgttcgccagtctgatgaacgcatggaatgatcgtgacgacgaggcgaaagccaatcgtcatttcaagcaagcagaccatctcgattccaaattcaagacccaacacggtcaacattatgaggcttacattgaacgctatgaagaattcgaacgcaaaaggcttcacgctgattgaactgatgatcgttgttgcgatcattgccatcctggcttccatcgctgtcccagcattcaagaagtggagcggcggggagtcgatcacttcgagtccggcagctgaggtctcgtatgaggctcgctgcattgacggtcagaagtatgtcgtgtctgccgaaggcgcggtgctgatgaaggactccaacggcaacgtgatcacctgccaatgagtgagatcattcggatcatggaatcggcaaagaaatttgccgaggcaaacctggctgagggtgctcatgagctgaccaggatgtctgaaaccggcatcctgaaatcgaagggcgtggttcgcgagtgtgcgtccatgctcaacctgattccgggaatcgagtcactcaacctcgcgcagacacttttccgcacggctgccctcgaacgcgctgccaaagactttaaggaacgctatgaccgctcttaacaaggaagcagtcgacgccgtgatttctctgcgtcacattgcggatgacgctgcaaaggctgtcatcaaagaactcagcaacaaagatattcctttcgaagatcgctgggctgtctacaagcgcctctgcagggaagacatcatcttcgagttcgatgactatggctgtggcgaactgcacatgctcgtaaaggtcgaagatggcgagtgtgaagatggtctgcatgccctaggctacgaacgctatcaggctatcgaatgggttgatctctacatccagatttctggcaacaaggaagagtacaccgaagagagcttcaacgcatggcgtgagagcattcttcagaacccttccaagggcctcaactacgactggtaaggaaagacaatgaaatacggctcctacgagcatgtaccgctcgacgatatgatcggtcttacgatcgccagtgtcgaacagtccagcgatcagatcgactttcacaccacctgtggaaagcatttcaggatgctccatttccaggactgctgcgaaagcgtctatgtcgatgccattgatggtgaccttcaggggctcattggtggagtgattcgttcggctgaaatgaacaccaattcaggtgagagccgctacgactcggtcacttggaccttctaccgcatccgaactgagcgcgaattcgttcacatcacctggcgcggttcctccaacggctactactccgagcgtgtgagcttcgttcgtttgttgaacaaggaagagcgtactcagcgatacaacgagcgaggttggtaatggctactcgtgaatttgaagcagaacacatctacgaacgctcagtcaaggccatcgaaggtgtccctgttcgtatcgaagaacaatgggttgaggactgcaaagaaagctacgatcgtcagaccaggtattacgaacaactcaacaagcgactcttcactcggctgggttggcgtaaggttgtagttcagcgacccttcgaccagtatgtccaggaaagtaaggaagaggaagattactggggctacaactcgtatgacatccttgtctcccgatacaacgatgatctctacgaactccggcgtattcggaacctcgcggaagcaaacgctgcagcaggcaagactgtccgactgagcgataaggacttccagactatccacttctacgagaaggctgcgccatgaagttcaaccgatactggatcagtggtcgtggcgggcatggttacgaaaagtggaagtatttcgaaggtgacttcaacggagacatcgaagacgcctggtacgaaattctccatagcagggagacctgggcgatccactgtgagtgcagctacgccgtcgaactcgatgtgattcctccgaaggaattcgtcggaaacatgatcgccaataccgccgaggctctgttgaggaaacagcagttcctcgaagaactcaagacctactatcaaggaatggaatgagcaagaacatcaagcccggctatcaggttcacgtaacgtcgtgggaaaacgatgccgacaactacaagacagaaattctttctggtctgacgaaagatgaagcacagttctacgttctgctcgcgacagctttcgaatctcgctacaagaagcgtccagccggtctgccgtataaggtaagcggcaacgacgaaaacaagacggttgaactgctcaacctgtggctgtatgctgctgaaaagcatccggaggtagctacgaaactttggggcgatgaagatcctctgccgacagtagaacagatcgagctgtatgacgaacagctggcgctccattataatgatccacgtaggacggatgagaagtacgcaaacctagattctgcatctaggttcgtagatttcttcagctctcttatgcaggagttgctcgcagacccaagcgaagtttattgggacttcaagaacttcttccgagtgtgtgatgaagtaaaggtctattacgtacctggcgccattgaaaacgtaaccaaccaattcattgacaaagaaggaaatctgatctgatgtttattctcattggtgcaggaattttggcactcctggcagcagctgttatcttctgggtgctgaatctgcgtgtcgtcgttccggcgaatgaagtgcatacgctccagcgttcgaagtctcagacctcgtacggtaaggaccaggatggtggcaacacttactacaactggccttcctggattcctctgctgggtctgacacgcatctctctgcctgtgtcggtgttcgacctgaacctgagctcctacgaggcatacgacaaggaccgtgttccgttcaacgtcgatgcaacgagcttcttccgaatcgccgattccaacgtcgccgcgcagcgagtgtcgagcttcgatgaactgaaggaacagttgactgctgttctgcagggtgccattcgtaccatcctggcaagccacgacatcgacacgatcatggtggaccgcgctaccttcggtgagcagttcactaaggaagtcagcgagcagctgaagaactggggcgtcgagccggtcaagaacatcgagctgatggacatccgtgactcgaagggttcgaacgtgatcgccaacattatggccaagcgcacgtcggcaattgaacgtgactcgcgaatcgaagttgctgagaacacccagctggcaaagactgcggaaattgcagcagcccagacggtccagctgcgtgatcaggaagcccaacaggctatcggtcagcgaacggctgagaaggaaaaggcagtcggcatcgcgaaggaaaattcgcagcaggaagtgctgacggctcagcgtgaaacgactgtgcgccagatggaagtccgcgaagttgaggcaactcgtgcttcggagattcagcgtaaggtcgccgtggtcaaggcgaacgaggtcaaggacgtcgcaatcgtcgaagcggaaggtcagcgtcagcaggaagtgatcaacgcagaagcacataagcagcgcacgacactggtcgcagagggtaacctggctgctcagaagctgaacgcggaaggtatccaggctgagggtacggcaaaggcagaagctgagaaggcgatgcagctggcaccggtgcaggcacagatcaccctggctaaggaaattggtgagaaccagggttaccagaagtacctgatcgatctccgtcaggtcgaggccagcgagaagatcggtgtcgagggtgcgaaggctctgcagggtgctgagatcaaggtcatcagcaatgcaggcaacccgaacgaaggcgtgaccaacgtcctggacatgttcggtacgaagggcggtacgaagatcgccggcatgctcgaaggtctggcacagtcggacgtcggcaagcaggtcatcgacaagctgaccggcaagtaagaacctcgtagttggggaaggtggtagccagggcaacctggctattgccgtggcataaggagcaaattatgaacaaagtcacatgggcagtacagacaaaccttgtagcagatcacacggctgaggctgtatggaatgcagcaaaggcattgggttgtcagaccgttgaggcatcggtcattccgttttctctagagttcggcaacgaatcagagtatgagaacatcccggacgacacagtgatcattccctacggctcagtcaagttggcgaggatggccaatgagcggaagtggaaaggcagctgctacgacaacgaacgtttcgacgctatccgatggaatacggaacgtgacgatatgctcaatggcgattgcattcacctgacaatcaaagaactgaatcactatttccgagactgcgccgacgacaagaagtggttcattcgtccggtcaaggatctcaaagccttcaacggtactgtcgcagatacggcagacatccgagactggatgcagagtcctcgttctggttcgtttgagtttggcgaagacacacaggtcatcgtagccgcagtgaagcacatctactgcgagtcgagatggttcattgtcgacggaaaggtgatcgatggttcactgtaccgtttcggcggacgtctcatgtcagaacacttgaacgatcccgacgcctacaaacacgctcaggctctcgcagataagtggttacctcatccttgctgtgttatggacgtcgccgatacagaggacggaatgaaggtgatcgaattcaacactttcaactgcgcaggtttctacgaccaccgcattgataagatcgtaaccgcaatgaccgaatgggcagagaagctatgagctacgtaatcgtcgaacactatcgagtgggttgtaacatcgtctctgtacagggtccatttgagacaaaggaagaagcagttgcagaggaaaggcgcctcaatgcagctgagatggaacagagacccatgctctattactacaccgtcaagccactagtcaaggaattggtagagaggacccgtggctctggggtcgatgaaacgggtccggagtggtcatgagctttcaatatgtcgtcatcgaaagaaacaggaacaaccctgagttgatcaccaatgtcatgggaccatttcctaagaaggaagcgttcgaggtcaaagaagatctgactgagtttcctagtccctggtactacaccgtatctctcctcaatcctggtcctcgaaaataaaggttgcaccgtagaaagaactcctttacagtttgattgcctcaatcggaggctgaaataacagaggagtagatcatgtgtgacgaaatggaaacccagaccgtgtccgactccagcgacaagctggcgctctacaacccgactcccttccagcgtgaatggatggagcggaagcaggaagaggcggacttcaagtactggctccatacccgctccaagcccaagcgtgtcgagggcaagctggtcctggcctacatgaccgaggacgggctgcgggctgttcatctgggacgtaccgaagtcctggcagagaccaagtaatacaaggggcccggaggaatccgggctcttttgcggatgaaattcacacagatacgtaagtgtctgatctataagattgtcccaggacacgaaagttctatataatgacggtacggacaaacagtagggcaaccagaaatgaagaccgccacgcaccgattcatcaagtctgaaaaggtcaagttcaaagtcggtaaggacttcctcggaaaggttcagtacacggtcaagttcaaggatggctctactacgacgatgtccgaaaagaatttcaccgaaacgttcgtggagaacaagtgatgagcggttctaacttctactcgaggctcggcaacatccagaaggtgtccggagtcaagttgaacatcgacactggcgaccggatgacgttcaaacccgagcaccgtgggtttgtcatcatccgcatcaagtcgaacaatgtccttctcgcatacgacaagacgcagaaggacgctttggcaaaggtcgaggcactgttcaaaaatggtcgtctcgtcgaactgtccaagctgccgaaacaggcgctggtgcaggccactcctccgccgtgtgcagtctaaggagaattgacatgaaggttgaactgttcgcaaacactagcgggcgcggacactggtcatccgcaaagaaggaagtcttgatcaacgcgatcaagatcgatcgcgcatactcctacgacggcgacgaggacgtgacgctctacatcgacgcacgtttcgacgccaagacgtggcaggttcgcaacgacggcttcatctacaccgacgagaagttcctgcgcgagttccgtcaggggctgatcgagatgggtcttccgaagaagctggccaacaaggtcgagtacacggaacaggggatgcagggtcggctgtatgtcagtctcgcgttctacggaacgaagaaggacatcccggcgtgggaagagtttatgggtgccaagatcaagctcgaggaatgctgatcctcgattcgatgtaaccaatcacaactggagaacagagatgaacgaattgatgagccttctgttggacctggagctgatcgagaagatcgagaagtttggcttcaccctggtcggtgtgttcgatccggaaggcaatgagccggggttcgtgtataccatcggactgacggagcgcggctggcccgaagtgatcatgatcgggaacatccatccgatgatcgccgagcagttcctctccgaaatgatcagcaagtggggcaaggctgaaaaggtgatcatgggcgacaacctggacttgatccagttccaggacaagtcggtgcatccgatccgcgtcatcgacgtgaaccagaacaaggcagaagagaagtatgcctgtcgtgctcggcacctctatccggatcgcgatgtgaagtatgtccaggcgctgatccccgaccgcttcggcaggttccccgatgaaccggaatacgaccagtcgaagcaagcccagcccatcatcgcatcaagtcgaacaatgtccttctcgcatacgacaagacgcagaaggacgctttggcaaaggtcgaggcactgttcaaaaatggtcgtctcgtcgaactgtccaagctgccgaaacaggcgctggtgcaggccactcctccgccgtgtgcagtctaaggagaattgacatgaaggttgaactgttcgcaaacactagcgggcgcggacactggtcatccgcaaagaaggaagtcttgatcaacgcgatcaagatcgatcgcgcatactcctacggtgaagaggagttcggcatgaacgaggacgtgacgctctacatcgacgcacgtttcgacgccaagacgtggcaggttcgcaacgacggcttcatctacaccgacgagaagttcctgcgcgagttccgtcaggggctgatcgagatgggtcttccgaagaagctggccaacaaggtcgagtacacggaacaggggatgcagggtcggctgtatgtcagtctcgcgttctacggaacgaagaaggacatcccggcgtgggaagagtttatgggtgccaagatcaagctcgaggaatgctgatcctcgattcgatgtaaccaatcacaactggagaacagagatgaacgaattgatgagcctgctgttggacctggaactggtcgacaagatcgagaagtatggcttcaccctggtcggtgtgttcgacccggaaggcaatgaaccgggcttcgtgtacaccatcggactgacggagcgcggctggcccgaagtgatcatgatcgggaacatccatccgatgatcgccgagcagttcctctccgaaatgatcgccaactggggcaaggctgaaaaggtgatcatgggcgacaacctggacttgatccagttccaggacaagtcggtgcacccgattcgtgtcatcgacgtgaaccagaacaaggcggaacagaaatacgcctgtcgtgctcggcacctctatccggatcgcgatgtgaagtatgtccaggcgctgatccccgaccgcttcggcaggttccccgatgaaccggaatacgaccagtcgaagcaagcccagcccatcatcaagtagaataaccagctgtgaaaaagcccaggcgatgaacctgggctttttcgtgtttccaacaatcagcaagtagcgcgactgatcttcaactgtcctgcgagtacgcgtggcgcaccgtcaccgttgttaaccgtcttcgctgttgcgagtgtagcaatgtagagcaagtttccgccggtttccgcatcatacagtcctgcacccgtaatggtaccccagtttcctgttggcacgttgtaggtgacgtcggctgcattggaccattcctgattggtaccggaaggaccattccacgaagtacctgttgaaaggatctgcttacgtccgtagcctgtaccggaagtgcttacctcgacaccacccgtaccagcaaggctaggcacagtcgtgaacagggcaagccaaaccgaagtaggcggagtgtacgcagttcccttcaggaagtattccatgaacttgttgaactggtaattggtagaggtcgagcttggcattataaaagttccttgggttgtctcttctgatatttacagccctgtgatacatgtcctcgcatgtgtggacaccgtattggaccgttctgtataatttgatttatcagaaagaaaagttagaaagaaaggtgcctgggtcaagaaccagctcaacccagagtttaaggcatgccttgatcaattgagattgatcatcattgcacgaatagccatctgagtagctgcaccgatggtcattgctccaccagctgcgatagacacattgcctccggctgccaacgaataatttccgttcacgatatctgtcttgttaccggatacctgagtcgtgcaatcaccattgactacgactgtcgcatcaccaacgatgttgacttgaacttttccttctacgtgtaggtagtcatcacccatcacgacacggtagttgtccttgaccaccttatcgacattggttccatctgggtgtacttccttgaacgtgcctgttgggtggtactgatggaatcgttccttaccgggtgtgtcgtcgaactcctgcaggtgacctccttcggtctccatgatcttgttcaatggatagagtggtgcagccatagtagtaggctccaaccatccgttcattgatgagatagtcgtacccagtgcgcggatggcaccgaggttaggaatagatctcgacaggccttgaatcgtggttacaatctttccgatgtttcctgcattggtgatggcatcctggagacgaccgatctgtccgatcgccattggaatgctctggatagaactcatcacagagtcgaagtcgagtgacttgattgccctcactgcggcttccacatcacctacctgattctgtaccaactgtcttgccagtgcctcagggtcgaggttcttcaggttctcgatttgtcccttgatcgcgttcacttcgccttcaacctgggcttgcagtgccttagcctcagatgggagtgtggcgatctgtgtcatggtagatgagatattgttcaacccagccatgaacggaagattcgacagacctgcgatgttcgagaactgatcacgaacactattcaacttagacttagcatcctttacagtcgagttgatcttgttcgccatgttggtggcagcagacagtccactaagagcattgctattcgccaaggacatcttgacggctttcaccttctcagcgatgacggtctgtccgaggtcttcaccacgagcaagattgttcgtatcaggcttccctcctggagcacctgcgagtgtacccatgatgataggagtctgagcattctttccgtcggcaaagaacccaaccacatgggagccttcttgaatacccgtaggagaagaacctacaccgcccttagcggaagaagtgataggctgcataggcacagcccatggtaggtcggaagtcggaatggcttcgtcatcatagtagccgaatgcacgaacacggagacgacccagcttctctggatcatttctatcctcgacaactccgatgaaccactcgaaggcaccgccaccgaacgaaaaattgtgtacttgcgacatagaactctcttattggtatatgtaggtcttgaccgagtaaacagagcagcggtacgcgtgctcagtcagctgttatgcttcctcgagtctcttcttgaccagctcagcgttgatcttgtaggtgtctttgttgatcatgtgagccatgtgagtgatgacatagcgtccacggcgttgagtatcgaactcttcatcggacatagagtcctgagcaggcaggtccacatcaacggacttcgcgaaccatctagctgcacctgccgttcctgggaactggatgatcaacttgtcttgctcgaacttcatcaacgaagacttacgggaggcaatccaggcatcggcggtatccgaatacgctgcattcttgaacatgccactatgcttaggaatgaacgaaatgttcgcatcctcggcatccatgagatactctgagtctaccttcaggtacttcttgtcctgcgcgttgtcatcaccaaacttgaacgtctttgtttcccatgccttagtcttgaagtcataagacgcagtctttgaggagtagtaacctgatgcgatgttactcagtccgtcgaagtggtcaaaccaatagacaccaatggtagtggcatagtcgtagagcgtatcacccttgttgtcctttagattggctgggcgtacctggaacgtgatacccgagtactccgaggaatcggaatagagcttctcaaaggacttgaacgcgaagtccccgttagcctgctgatagaaggcatagtcggcagcgccatcctttgtggcagtctgcaacaaccacgacatagtatggaacggagtccatccaggcacgatcatctgcatcgtattgtcggtagcatcaacgtctaccttcttaccaaaggcttcacgaacaacggatgtggcaatgtccgagaccttcttacctgcataggatctcttgatacgctttgtctgattgagcaggaaggcctcgtcggctgcatagacagagtactccaacacaccctgggaactagccaccttatcggcgatcttgtagatgacgaactcccacgactgttcaccatcaccaatagacgccatctcagtctcgatctctactttgatacgagtaccagaacggatagggagagtcatcaacagattcgatgtatcaaggaagttcacaatggcagtagtcgtaggagagaagatctcctgaaagacatgtgcactgatcacagcctgcgatacatcaacatcgccaatggtgacgacaaacttcttgaggtcaccatagttggcactagtcgtagcagtggtcatacttttccttcaatgctcttattgaacaagtctacaaattggttgatatagcgcggagccacaatgacgatctttccacgcttacggttcaactctgattcggcttccaatgcagtcacaggatgaacattcgcaggcatagggttaccggcgtcaatataggcacggacagctgcctcagccacatcgtcaagtcgatagccttccaagtccgtgaagtagacaatggtattcaggctaccatacttagcaacaacgaactcctcgagtacggaatcatccataggccaatcgagcaacggattcaccataccattgacaaggaagaacacccaacacagagtagggtccttgtagagctcatatgccaacgactccgcactcgcaccattaggtacatcataggactgatagacataggacttgtccacgttgatacgcttcaacaccgccgcagtgacgatgttcatagcgtccttgttgtacccatccagtgtatagctgagtacaggaaacttcttgaagaacgatggcatatcagtaaccctccacgatgtcttcgcgtgtcacaatctcgagttccttccacttggttgacattgtgatctccgaagggaatccgtttctcatagtagagaacatgccttgtccagtatagtcaatgtcgatagacgtacagacggaacgcttgaacttttgaatccactcgttgtcctttccctgccataggtaacggatgtcacactcagatgggaagttgagcagtgctttgttattgcctgtccccatagagtccttactatatgaaggcaaggcgttctcacggaagacagagatgatgtcgtagatgtcctggcagtcttcttctcggaatggatagaacttaaagacgaatgcaaactcacgtagaccaacgcctttgaacagcgcagtcacatacgggttcgggatcataccacccacggcgcccattagtccttccgcagtaacgttaccgcccattagaccagcggcagcacttccgaggttggcaagtccataggcgcctgcgagctgcataccatcacctgccatacctacagcgtccccgaatgcctttccgatatcgagaccacctttgagtcccgccatcgcaccaccggcagctgatctaatagcgtttccgatgaacccgaggtttgagtcgccccagtcaaccgtagagggctgggcaaccgattcgggcatatacagatggaccgtattcaaaggactgctttccctaggggagcttctctcaaagaacttgaactcgatcgcagctgggtgtactgactcgtccgagaggtcaggtgggtaactgtatagcgttttgtttgatcgttggcgtgccacaatcgtatgcctaaatatagaagtctacagatatttaatctgggtgaaaaggcaggtgccttcggctataccgtttctttcacaggattcttagcctgttttcaaccgagattatcaacttatagctgaatccctatgcagcttcctaaacgagtgatttaacaatggcacgcaagtatcaacagggtcgctatcgcctacttcatcctgaaaagtacgtaggcaatgctaatgatgtggtgtatcgttcttcctgggaacttcgcttcaatagatggtgtgacctcaatccttccgtagtaaagtggaacagtgaggagatcgtcattccctattattcctcggctgagtgtaagaaccgtcgctacttcgttgactatatcattcaattgaagatggctgatggttccttaaagactatgctgattgagatcaaacctgagtcccagactatcgctcctacaaagggaaggaagaagcctgagcgttatcttgaggagtgcgttacctatcaggtgaatcaggataagtggactgccgcgagggcctatgcagagaagcatggcatggaattcaaggtgatgaccgaatacgatttaggcattgccaaaaggaagtaacatatggctactgtaaagaagactgcaaatagaacgagcgcacagcctaaaaagaccattgagcaaaagctgatccttcatgatcgtaagcgtacgcagaaggcgattgagtggttctataccatggcaaagtccaagctcaagcgtgcgaaagttcctgaagaggcctttggtgccaagcgcaattcatctaccttcattggtggcatgtttatctatacctacgatcctaagtacaaagatgtactgccctggtatgatactgtgccttgtgtgattcctgtcgagatgtattccgacggatggcttgggctcaacctgcattacctaccacccgtgatgcgtgcgaagctgatggataagctcatcgagtatcgtaagcgtgccgggaccgacaaggcttatatggctgtgtcctataagctccttaagaacgtcgtgaagtcaaaatacttcgcaccatgtgttcatcgctatctcgcatcacacgtcacatcgcgtttggtacaggtatcggacgagtactgggaagaggtagcgatgcttccactacagcaatttgagaaacaaacagcccgccaggtatggcgtaagacaggactggcatgagtaacgagaccctttatatgaagttcctctctcacttccaacgtggagtgatgagaccgaacaagtaccttatccgattcactctacccgagggtgttgcaggcagtgctgatttcatcgatcagcgcgtacgccgcggacgcctacagatggaggaagcccgattcaatggcatcggttcgatcaacatcaaatgccacacggctaacttccctcagcgcaatctggtgacgagtgaacgcgcacagaacagctcatcgttccgtgttccttatactcaggcatacgatcctgtgacgttctccttctatgctgatgctgatgcagacacccgtcgatacttcgacctatggcagaacaccgtcatcaatgtgcgttccaacacgctcaatttctacaacgagttcacagccaatgtggagatgtggaacttgaatgagatggaccagccgacctatggtgttcgactcgaggaggcttatccgattgccgttggtgccatggacattgcttacggtaactcgggaacctatcagaccgttacctcgacgcttcaatatcgacgttgggtacagattggttcgagtgccgacaatcaaagagcgcagaactccggaaccaatctcggcggttgatgcttgcactaaagcccggactcgtcacccgggctttttcttggttagtggttgacgcgaatcgtgacccagttccttgccacctcgcccatcacaaactcgttcttcagtgcgagagcctcatgaaggaatgctcggcggtcctcaggactgactccttgagactctagctccctgctgactgccttcaccaattcccaatccgacatctgtcctgctaccactgcaattgctggatacttgggctgcatgactctcacctcacaatcttgtcctgtttcccccgattacccgactcagatgccgggcaccttgagtatacaggatcttaacaggagcccacaaccacattgctgccagtcgctgacccgtcatctgtacgagccctgattgctggagcccaatagaatcagacacttacgtgcctgcccttcctgaccagaatgctagtaatatcaaggggttactggatcagcgcttaaaagctgggcggtccgtagagtcattggactgtggtggtccgcttaacatctttttaacatctataggaataggttgtcccaggagccttcacggctgtagcatccggtcatcggggacaaagaggtcctcggaaggctcattcacaacaggagacataccatgaaggtattgcagcgtgacattccttgtgccgtggttgcccgttatgacgatggcgatgtggcggcactctgtatcgagatctatgactcgaaggaagtacggattgtctatgcaggatcggatggtcctcgatacattgagatgaagcgcatcatcaagaagggtccgaagttggacctggatgcaatggtagccgcaatctaaaaacaagcccaggctcatcacctgggctttaccacggttaaatatctcatcctacaaacatgtgatgcgatatggctcgtacaaagaaagtgattgagtgtgatccctggtacttccgtggtgagcctttccctgaggaaggcgctgacggctatgagggctttgtctatctgatcacgatgccgaatggaaagaagtacattggtaagaagttcttcaacggcatgcgaaagcagaaaggaaagaagcgacgctcaaaggtagcgtccaattggatgacctacttctcttcctcagagtacatcaacaactatgtgaaagagaatggtacaaaaggaatcaggagagacatcttgtccctccatgagctcaagcgcgatgtgaacttctgcgaaatcctataccagttccaattcaatgtgcttgaagagaaagacgccaacggcgagcgtgtctggttgaatgatcagatcaacgggaagtggtggccacatcttgtgatgggttggcgcgaccgaagcgatgtatgtctgccactttgagtgacggaaactgcttctccgcatcgcgagtgttggaatcgattttgacatagagatgcccgttccaattccaagcgatgtgatcgtagtacttcaatgctgcatcgcgagcgtcgtatccgcagaagtctacgtctgccttttcggcatcatcaaagcggacgatatagcatccgtccgaaggcagctcaggatagtcagtggctgaggcttccaactcctcagccacttccgttttgcctgcccgaatcagcacatcgagtgccatgcgcagagcgccttgatcgacgactaccttactcattggtcactacctttcggcgcatctgtttgattgcctcggcaatttccggacccttgagcgatgcctgttgttctcgagacagttcagagaagcccagtgaacgtgtgcagctccaggcaacgatcaggtcgttgaagaatcggctgcgagccataccaaccttgcacaggtcacggatcattgcttcccatacctcaggctgcctgtaggcattgatcatgtagagaacatcgacctgattgctgtccagtcggcagctctgcagagtgcgatacattctcgcataacggcgccactcgttcgacacgcccatcctgtcttcgacgttgagcgcatcttcctcagacatgattgatgcgatcatggcatatacgaatggaacagagccgccacgagcattactgatcagcctgtaatcgatcttgtcgatagacagctcgggaatgatgacctgtagagctccgaacgattgcagcgtggtcaggaacagctcaggttcgggttcaccgaatgccttttccatttccaacagcacacgctcgcgcgtcagatgagccaggtcgccacggcgaaccatttccccgatcagtgctttggtatcatccgcgacaacccaatcaccgccatacctggcacggaagcgagcaatcctcagcacacgcacaggatcttctgcaaaggcaggagagacatggcgcagtaccttggctttgatatccgcctgtccattgaacgggtcgaagatttctccggtgtactcgtcctgtgcgatagcattgatcgtcaggtcacggcgagacaggtcctcttcgagcgagacatgctttccgtggtcagtggtgaagccgttgtaaccgacgcctgtctttctttcgatgcgcgccaacgcgtactcgacgccttcctcgttgataaagacagggaagtcggcaccaacctgtttcagtcccatgtccagcatttcttcgggagtggcaccaaccacaacgtagtcgatgtctttcgggatctttcccatcaggctatcgcggactgcaccgcctacgatgtagattttcattggttgagagccttttcgagtttcagaatgtcttccaacatcttgctgcctttaagtttcactgccataggcgcaggaatgctgtttccgcttttgatccaggctaccacttcgcgagcacggctttctagattatgcaagcgctcttctgtgttcatggctcagtgcatctttctcttgagtgaggagttcacatgcagccttccgccgcagtgttggcagtactttccttgcggctcggggaccatcggcataccaatgcaatcctcagcacggatatcttccagctgtccgcattcggtgcggtaggtggcatagtagccatcaaagccggtgatcctccagaggcatttctctgggcgaggagggagatagtcctcaggaacaggacgaccacggttcatgatgttgagatgatattcaatgccgaaatcgttttccatcatcccttcctcgccttcacctgtaccactttgaattcccaatccgtcaatcggtattgctcattataacggtcccaccattccatctcagcctggacaccttccatggtttcggaataggaaccggcgacctcagaccattcttttaccatgggtagaggactggcctggcggcgatgatgaagtacgaaaggcattacgccaccggtccacccaggcgaatagctgcatcagcgatgaactgcaggagatcatactcgctcaccacacccaggtcgcgctcggtgatctccttgatctcgtagaagccaggcatgggctgactcacgagcaggcgagtgcaaggacgaaggttgatgatgcgatttccctgtgcgggattcgagccagcctcgcgctgcttctgttcgtaatcagcaatgtaatgctctactacctgcttggcttccaggagacctgcaccggtgttggcgcggaaagtcttgatggcctcgacctttcggttcggctgccgtgcctgggtcttccagacagccgactcggggtcgctcgtgacacgataggagtaggcgttttcgatgatctggttcatgtctgtttccttacttggacagatacttcgggaggttgtagtcgagatagcccttcggcttctcgcacggcttgtcgttgctgcacggaccgaggtgagtgcgatcaaactgcgtttggttcgcatactgctcagccgacaccgtgtccttgtaatcaggccaggtcgtcttggtcaggaagaatccttcttcgacgatcggcttggcgtagggtctcgtgtcagccactgccacaaccgtcggttctcgcagttcacgaacgagctctaccgtctgaatccacgggaaggacacgacggcatagagaacgaaaatggctcccatcttgaaatagaacgggtcggcgttgtatttctcgcgtacattcttgaacagcttcacagtggtgctccgtttgtcgatataaaaattgtacagataattcctttcttgtgtggacgaaaatcagccaaaagaaaagctgccttcttacgggcagcttctctcagaaactttcgtttcagtgcaacgtgttcttgcgcgttgcccgcttgacggtcttcttggctgccttcttcgcaggagcctttcgagcactagcacgcttcttcgctcgacccgtttggttggcgctcggattggccatgatctcttgctcgctgacttgcttgatccgatcaatgaagaccggatagtagcgccctgtggcaggatccttgcctatcacgaaccggacttcctcaccaccgcggtcgacatgcatcttgcggacggaattgacagcaccggagggcttggcgtaggtgtgggcgggagagatgagcgtagacatgacggtgttcctctgtggttggtgccggtccagaaagtttctgccagcacctgcattatatagaccactcgttaagacgatgtgtaggccattttctcaggggatatagaggtaggagccttccgggatgtgcacttcaacacgcatcatctcgtgtccccaggcatccgtctgcacacgaatgtaatcgaaaccctgggtgaaggtatagacgccaaccagctcaccggagtagtcaggttggccaatccacttaccgcagtgcatgttcatcatctgaacagcggtgcgatgatcaaacgatgcagtcttgacgtgttgctttcctaccttgacccagagctcgtacatttcaccctgcggcggaggagcctggcgcaacaccggcttctggcgattgaagaaacgactgagcatcacatgtctcctgcgagttcgatcagcttgttcctgcgcttgctcttctcctcactggagaggttagcccagtactcaccgccatagagctgtgcggctgctcgctcagcgcgccaccagagtgctttcttgagatcttccgggttcattgcttcttcctcacgtcactgccgaaaactgcttccacacgcgccataccatccttgagcttgcgataggcgcgaccatgttcgtcgttggggctgcacgagttgtccaactcgatatcgaggcggttctcgaactcatgccagatggtcctggcttctcggatgttcagttcgacttccaaggatcctgcctgacgcttgaagcggagcttcttatccaggtcggtcagttcctcgatgcggtcaaacccgtagccttgggcgatgtaaccctgcatcacatcgccattgtcgtcgaagccttcctccatcaccgagaccaggaaggacatctcaccccgctgccacttggtcaggcgaaccttattgacggaggaagacattgcacatctcctggtagtaggtcccgatcagttcgatatcggaaacgtccatcggaacatcgtgtcccagagcacggcgcgccacatcacgatacaccatggcgcgctcggtcatgttgttcttcgggtccatgatgaagtgatgggccttgaggatcttcggcatgtccttgacagcctcgccggtgtactcttgcaggaggatgttctcgaccttcattagaagacatcctcgaagcggtagatgcgataccccacatccagcgcaattccgatatcgacggtgagtcccgagaagcctccgatgttgaaactgtgcggctcactcaccacataggcagatgcgccacgccccttaggagaggtcaccaactgcatctcgcccctgttgaaggacaggatctgcgcgaaggtgccggcgtcgatctgtgcgacctgctcaccgcccttggtgaggatgacaaactgcctgctcatttctgttcctccagcttttggatgattgcatcaatcagggattcgtcgaggacatactgcttcgggtcaatgcccaaaccgatggcgaagtcctcgagctcgctacggtctttggtatacagccaggcgttgtgttccatgatctttagtccacgcaatagttggggaccgaaccactgtgcatacattcggtcggggtcgtcatccacagcgcaccgatggtcagtgccacaacgatgccaatcagaatgttcctggtcttggtcttcatcagatgttcctctcgtaggtcttgacgatgtagacgcccttcggcgcaggaatgatcttcgcccgggacatgaaccaccttccgcagcagtcccaaccgttcatgcagtgaccgcactggcacccactgcgctctacgatgccggcatcctgcagcttgcggatgaagttgtagcgggtcttcctgttcttcaggatggccttgcgctcacgtgcgttgaggctgaccaggatgtgccgctcgacctgctcgtcatggtatcggtcgatgtagaaggtcttaccgcccaggatgcgcatcttgctcatgatcgtctctccttacatcacgcagaatttgaagtgaacgcctgcctggattgccgtttcgcccaggaacaccggatagaagcgaccatcggtgtgcgtcatgatgacgtatcgcagcggactgtttcccacaaaatccggaaggtccaacttctctactgccttctgagcattctcagcggtcttgtaggtcttgttcggttccaactgaacttgcttggccatgtctgctgtcctttttccgtttcgggctgtatgtttgccccacaaccacatattaaagactttcgtaggacaggacaatcttatagatcagacacttgctaatctgtttggaaccaagaatcagacacttacgtaggaaacccagagaaccttgggttacaagggctctgggtctcaggggttttggtacgaagtggttgcagaggttctggtcttacttttcctcagtcgcgaatacgaatgcgatctgactgaggtcgatgtacagcatctgttgaccttctgccagttcccactcgatggcggtgacacgatcgccatcatacttcacaacgaatttcttgacatgaggaatagctacaggctccgagctgcctttgaacagaatggatacagtgaaagtcattactcttcctcgtcgcggaaattggggttgccgattgaacggagtgagaaggtgctgagatagtgctgacgatagaagtccttgtaggactcgtcagagttctccgtaccacgcgctgcacgatggacgaacttggccaacttgccacagttcttctctacccagtctgcgcgttccttacccaatggaatgctgctcgcatgtgcgcccaggaaggcaaccgtctccatcaggttggttagtccttcagtcacgcgccgctcgatgtgatagatggcttccatatccgcttcgcctgcgagcagacttgggatcaggtcatccagcttctcttcgagtaccagggtagcgatatcgcgctcacgaatgtcgatcaggtgatggcgatcgcagtaccacttcgtcttgaccttgaagcgaccttcatcggtgtagatgacccagccttcgatgccctcgatggtctttgccgactcgaggtagtcgtcaaccgtcaggccctcattgtggtcgaccacaaccgagatgccccaggtctcggcgattgcggtcaggtccgaatatgatacgtaggaaccatcaaccatatctcgcatcgccaacagaacaagctgaggcgtctgaccatagtcgaggacgatcttgcaatcaggatcggtgtattcgaagatcggacagaagttcagttccaacatgctgagacagaaccgctcaatggttgcagtcagcgccttctgagcagccacagcgacgtcggaagtgaaagtcttcttggtcttgaagtgaatgtatccgtcgacgtggatcggagtgatcatcgatccatcgcgcttgtccaggacagcctgcaccttgtagtcacggatgatgtgcgcctgagtgtgcgccttctcgttgacgttgaagaacttctcgaatggcagcgagatcagcttacccgtttgggcgtcgaaggtaatgccacggcattccacgccaagtggcagcttccacaggtcgtcggtggaaagcatgtaagagatgatgacgacatcccgaccggcgacgttctcctcgcggaaacgaacgttcgggttttcgcggaagtggtcaaagtctgacaactgcagatacattatgaagtccttgggttggtcatgatcgcatgagcgagagcatggtactcacggtgatacatttcttccttggccagctgacctttctttcgtttggtcagctcattccaattcggattgttcttttctgcggtctcccaatcaatctgttctggcagtcgcttgggcatgttcttatccatgaccatagtctacagagaggagtagaaagaacaatcggtctcttcaccgttattgtagaaagttgctcggtcaacgcgtcgcatcacatcttgaagtttctcacctgtgatatcgacggttgcctctttgccgagccaccgcagtgtcgtcgaaagagtatgggctcctacgacaaacactgcggtatcaggctgcgggtggtagtgcatctttcgctccgaagaatggttaccaacttagactaacaggtcaacgatagaaaatgtgatttccgattcgtgccgttcggttgagctttcgcgcccatccaggattgattgaggtgttgtggaagtgagttgcaccattgaccagatcacggagcgtacccgtgagcgctttcattgcgatctcaccggcgagctcccaagcccgaatctcggactcttttctaaggcgtggacctccgctcttgctgctgtcgcagaaccaagagaattggcaggtgcccctacttttctgtttgacgacgccgcaggctgtacttggatagcgactgtcttgagtgcggtgcatggttacattagcgaccgctgtcattccgctggtgccctgacctcgggcttcgtaatagatatttttctgcaggcaacgaagctctgcttcactgggtagagcagcgacaaggatgtctggctctgcgaggtcaggtacgaaagtgtgtaccttgatggatgtatccacgacaatctctggcgctggtgccaggattacttcgggcatgatgatcgtttcggctgcgtgtgtattgaatgttgaaaaagttgaagtgatcagcagcagaaacaaaattacaaatttcttcataatctgtctcctttacagtgccgtttagggtaacagaaatgttacgccaaacaaccttgtattgtgctcagaatatttctaaaatattcaattttgagtctgggttgagttgtattgattcgattgaatcaggcgaacaaagcggaaatgtcgccccatacgacatctgcgtcatcattataagcttcgatgtctctgctcttgtagtcggcaggcagagcatctcgaagtgcgttgtagaccagatgatagctggtccagttaggctcgtcggattcgagctgagccttgatcagtgctcccatcatatcccacttgacagcatcttcattgaagggagagcatggtagaccatcagctttccgtgcaagggcgccctgtgtccaggaagcgccacctgcgaggatagctagagttgcggcttgaagtgttgcttgagacatagcttagcccttgagggattcgaacagcgcgtatgccttctttgttgctgcaacgcgtgcttcgtatccgttaaggccaccattgatcttgcgagtgacctgttcatacgagttagactcagcgagtgagttgagtccacgggaagaccagaaccaacctgcagacaatgctgcatctggaagctgctcaagtagagcaggattctttacaaggcgatcgtcgccatacagagcaagcgagcaggctgtgtagttggagcgacctgtgagctgcttgaggccacgaccaatgaacgcccagccgtcaccttccttggaattaccgaggttgttgagaccccagatgccaccatagaggatgttggcgagtgcctgttggtttgccttttgagtcgcggtgcgaccgtacttcttagcgtcagcctcagagatacgagaacggctaaaggtcttcatcactccttcgacagagtaattcagcgactcgcgcagtgtcttgaagccacccgactcaacaaaaatctgtccgaggaagtgtgacttctgattctgagttgtaatgccaaacttgatgcaggcatcttcgagtgcctttgcgatatccgcaggtgcacccatcttaattgctacagtttcagtgctcatggtcacttgattacctctctccagcctcgatcgagttcaatgaccttgttgcagtggtcacgatcgatcttgttcaatactttgcaaaggaagacacagaattggcaagacttcgggcggttagctgtgatcttgccaattcggctgctgatcgtttcatccgggtcaccaccaaacactgtgttgaaaaactgatcaatggcgatcagcatgttccagacataacgaccaacttttgtcttttgcatctttactcttctaggatatccagcatgtctaggatagacagatcagttgcggagagatcaaccttctcgaggtcatcgagtttgattcggctctcaagcgtaacttcaatgtcgtgtaggtccttcatctcttcgatgaggtcgttcatgactgcatcttcgatcttggcattgcctgcctcatcgacgatcagttcaccgttctcatccttagcaccaaacttggacacgatcttcatgcgcaggtcttggtaacgctccgactcaacggtcacagccttctgaatcttgctgagcttgtaggcaaccttgacaggtacctgtgctacgaatagacggttcagcagttcaaacacggctgggttttggaatgcggcaaacttcattgggtagactccgggcgatgtatcattacgttgtccattatttacaggcttagatcggggtaccgaattgcatgtagaactggaagctaccgttgaaggttgaggcaccatcgctgacagtgtagttcactgtaccgtttctctcagcgttggttgcggatgctgttacggtgatctgcataccactacggctgatagttgcaggaccaccactggcaaggctcgcggcagttaggctgtaggatccagtaccaccggatgctgtaaccgttgttgagcgagatgcagaaccgtttggtagacgtgatgcgttgattgaaggagccgacgcggtcaacggatttgcgccactagcgtttcggaactgtgacaagtagatagtaccgcttgtgggaacacctgcgtttgttcctgtgtttggaactcgcccgccgccgcgatagtactggctgatatagacaggattgctaccaccaaactcgttacgaaggtctgcaaacgagattgcacctgaacctggaattggcattagatactcgctttaggttctagaggaatggttccgcccttaagtgcatcttgggcgtcttgattgttgagacgatcactgaatacctgctcgaagtatgccttgatcaggaccatcagaacatagccaggcgtttcacctgaggatgtcacgatggtcgagttcatgatctcttccataggaacaatcagcacgccttggatgtccgcagagttttctcttgggcgtagacccttgtgaggctcaagacccttgtagacatcgttctctgtgacctggtcttgcatgaagaacgttacttgtcctccattggtgaccgggtcccattggatttgaatatttggagcaacagtctcgcggatacgagtgatgctctcttctcttacgactcttgaactcacagttgagcctccaggtattttacgcgacggcgaaggttctgtacttcggcaatcagaagcggaacagtctttgtccaatcaatggtcaagatgtttggcttcatagggttagggttgtctttggtcttgatctgattgtgagcttggttgactgcgacagcgtcagaatagacagcttgcatctcctgagccactgcaccaacctcacctgtacgaggcttgatacctaccttgtagagtgcaatcttttcctcgtcccagtcaaactgacgaatgcgaacgttctcgaagaagtgttctacgatatcgtttggtgcatcaacgatgttcttcttaaggcgacggtcagatgcataagcaatgatgttcccctgacactgccattcattggctgagtttcggaaacatgcccaagcaaagttgttgtgggccaggaatccatggttaccatcgttagcgtggatccaagatgtatttccgttgtcgctgtcccagatacggatcgtgggtgaggtaccctcgatgttgatttggttaccagtgaagtaccattggtaatcgttcttgactacaacagatgatcggatgcctgtttcgtttggagcgccgcaaccaatgtacatctgccctgaaccgaggtacatgccaccgaagtagttaccggaaccagcattgtccctcagaccgatcattccaccgtagttgcctgttgtgagcaaacccgcagtgttgaagtcgccagggttagatgaaccacccattgaaatcaagaactgcgaattcagcgtggaatatgctggacctgcgcctagttgcagctgaacgccattgttacgagctgagatgtagagtgcaccattggcatttcggttgacgatgtaaccgccacggtctgtaccggtgttgatgccggaaccaatgtcaacacatgcaacatctttgttatcatcataggtctgtaggtttcttccgttaccccagacacgtacatgtccatcaacggtcattgcaccgtcggtaccaagggttacctgtctggaggcgttgtccgcaccatttggtcgtaggtagacaacacctgacgatgcagacagaactgcaacggcatttgaggaagatacgtaccctgggaagattactcttcctgtggtgaacgtgaatgatgtggcgcggaattccatcggcgcaaaagctgaaccatcagcggtgatgccatcaattcttacagctgtggaagtatcaggattgattactcggatcttgttaccagtgttagctgtcttacctccgagatagatctgatcgcctcttgcatggaagtttccgttgacaaatgtcaaaccgtttagagaaagattagttgaacggatgctaagaggagcatatgcactattcgcactgttgacagcatcaatggttacaccggagattccctccgctcgcatgaaaatctgatcgctggttccagagactggctggatacgaacagtattagcatacaggtcaggacccacagcagctgtgatagtgatattggctgaaccatcgaacgccacaccattgattgtgcgagccgttgctagtttcgttgctgtagctgcattgccagacagagaaccactgaacgtagacgcattgatcgtactcgtggtcgggttcatcgaaatgatgttcgtgttcgcagcattagctagaacaaagtctttggacccagtgatatcgtagagctcaagttgagcagttgaacctgttcctctctgtcggaactgccatgatctttctgtgaccagctcaagaaggacagcgccagaagcattaggcgttgatgcgcctgcacgaacagttggcatatccacatttccagacgcatagaacacagtctgaaatgaggtgcttgtatcaccatttggtcggatatagacgaaaccacttccgccagttcctgaggataggacgatgctccctgtgtcagtgccgcgaagagttcctccgccaacaccgatcaatgcaatcttgttgtttggtagagtgaacgcgccgttgaatgtctgcatctgattccagacattcggtgtagtgatcaggttgttgaaatcgttgcgcagttcatcaatggatggagcataacctgtcgtgatagaaccaatctgcaatgagacattgccaaactcaaaccactggtcagcggcagtgttaccgtaaacacggacgtggacgtttgcagtcacagcgttagctggtgctacagcagtatgggtatactttgtccatgtctcagaagtgagataggatgcgttggatggagttcctgaataggaaattgctgctccagtagaatcgttccaacgaatttgaacgaacactctgacgccagcagtgcctcgagcatagattgaggcaatagctggttcgccagcttggactttagcagctttgatctgcgagttggaaacagcttcaaaatatcctgtggtggccagattagcaatatccatacgatatgctttacttgcgcttgacagtgtgctatcaacaattgagcgagtgacggttgcactcccgatgccaccgttgctacttgtccagcctaccgttgtaccagtgaagaagttaccattggcaatctgattgtcgccaccaatgcttgtctgcaaggttgtaacatcacttgccgctgcagcgccaatttccgcaaggctccatgatacgttggcagagccgttcaccgacttacccgtcgacccaatcgtcagggtgcgagctgtgccccaaagagaagtcgtgatgtttgcagagccgttgaagctcgttccgttgattgtacgcgcagttgcaaggactgtcgcagatgcagcagtacctgtggtagacagagcaccaatgtctgaaaggacttgagcaggggtacgaagctcaaaggcagagttggacactgcacggagatagctgtttgcagtcagtgaggcgagacctgttccgccgtagtctactggaacagtatcacccgtttgtgcttgctgcacttcaccgcttgcattgattagaactggcttgatagatgccatgtgacattcctagtaatacagcgatatttattcaaaggaaaaggagcactaggctcctcttccgtgtcaacctgtttttgattgtgtatcagagaacgattactcgctcgatgcgaagagcaagcttggtcgtgctcacagcgataccaaccggagcaaggatgcctgtgaccggagcagtcgtggtcagtgcacctgaggttgtgttggagaggtagtactttgcacctgtggtcaaaccaccagactgaccggtgatcgcatcccactgagcagttgtcgcggtaacaacacctgccacagcaacgtttgccgccgccccagccgcagtagagactgaagtcacaatgcctacgacgttggaggtgttgtagttgttcgcgtttgcaaggtcacaggtattagcaccggagatgtagactgctcgtccaatgacgattgcgcctgcattgccgttggtcagcgagcttacaacctgatccgaagcagtagatgtacctgcagtgacacgtccatagacgtcaactgtcacgctgttatacgtgcctgccgcaacgcctgtggtagccaggtcgagtgttgggttacctgagacaccgttaccgttggtgatggtcagtcgagcagttgatgccacagcaatagaacgcccggcgaatgtgccagccgctgtctgtaccaggaagccgttggtgttgtaggctgccagtgcagtgaggtttgtcgaagctgcctgagcgccaatgtctgcaggtgttgcggttgcaccgacagtgacacgaccgtaggtatcaacggttaccttggtgtaggtacctgctgagacaccagaagttgccaggccaattccgctacctgtgacagtgatctgtcctgatacacccacagcagagaactgcgtgcctgtcaggctgagaccgttacctgcggtatactgagcagcgccaccgacctgtacgaatgagattgcatcggtgcctacgacaggtgcagtcgtgttaccaacgccccatgtggtgaagccatacagagtaccctgttgaacgaagatctgtcgagcaggagtgaattctgaggactggtcagcatctgttgctcgagtccaagcgcctgtggcaacgacatagacaccgttctgggaagcagttgtctgctgtgcaaccagaacacgatcacctgcaacgagtgcaactccgtcgattgtctgtgtaccactcagggtagtgttacccgtggtacgaacctttgcaggagagaatggagggataccgccagatgccatcacagtatcgacatactgcttggttacagcgtgcatcgcatccgtaggatcagcgtgcaggctcaggtaaccagtgagcgagccacctgtaactttcaagtaggtcgagtcaaccagcgctgtgatgtccgctgtagtgacattggatgagcctgtgactcgtccgtaggcgtcgattgttaccttcttgaaagaaccaacgccgctatcagtgatagtagccagatcgaggataggatttccagccacaccattcgcattggtaatggtcagtcgagcggtagaggcaactgctacggtacgcgcaagccaaccattcgcgccgtcctgaaccaggaagcctgagcctgcgagcgcagcaagtgtatcaagtttgtcgctgtgaccttgaacgtctgtaccaatggcaaggccaaggttggttcgagcgcctgcggcagtagtggaaccggtaccaccggcatcaatgccgacgctgtctccggtctggaagcgagtcagctcgttattagagcctagcttaaggggtttgaagtctgccatatccgtctcttatagtttgatcgacaagtcaaggtcaatcaggaagtctgtgttatttaaggcgtagccgacctttacaaggtactcagggaattccgtaggcggagtcatcgtaagctgagaatcaatgttcacgtaatagaacatcgtcgttgcaagaccgccgacctgattggttaccaagtcccagttctcaggagacagagtgaatagaccggactgctgaatctttagctgttcccctgggttcgacgcatcaacagcaagtccaaggcatgtctgtcttggaccagtggagcgagcacgcaggtatgagttgccaaccttgcagacaggagtgccaggcaggaaggtttcgccaccagtgttggttacaaagatgatctgtgagtttcctccgccaccaccgcccgaaccaatttggttgtagatgtcgttgatggtgtcctgcaggccaggaatgtgcgagacaggaacttcatcggctgtatcaactacaccattagcatccttgtcatagatcgcacggaacatatcgccagttccttcgataggaatgacgataggtggctcagatgggtttggttgcagtggcaggaagtccgttgaagacgcatcctcacggtacttgatgcaaacattgccagagtttggcttgccgattacgagacctttcaagacagcacaacctcgagtgattgtccagatgcaaagttcaacgccatactctgtccccacttcaagaggaagatgttagcattggcgctataggtgatctcaaagccttggtcttccaatacctggaaggtaggagcaaagaggttctgcacagcaggagcaggaacagatgggaagccgaaggacagttgcaggttgccaagagtagcagcagccttgatctccttgccgagcttagtctgcagggtgaagtcagattcgttgcgaaggtctgtaccattggtcatgcaaaggtagagcagacctgcacggaatgcaatgcccaggttcggaatcatttctggaatggcacgggtaacttccctagcttcgagccaggacatgtttgggtgatcccatgcaattttcagcttgcctgcctctccatcataggtacagatgaagccacgcatcgtgtagtgttcaaccagcttgtagacaagatcaggaacatggtagagctgctcaaatgtcggagcgtctgccaaatagctgaaattgaacgctaccgcagcctcacggatggcttgatccagagcagctgtctgtccatcgaagtcatcagttactacgggaagggaaattaggtcatccatctatcaattctcgatgaaccaagtcgtggcgtcaattaggaaaactcgcacgcttgtattcgcaggaatgctaaaggtagttgctgacccggtacctttgacgcggaaagtttcaccgctcttcggagtcagcgtaatggctgccgtatgaagattgtagatggtgaatgtgtcggtatcagcgattacagctgcatcggtggtgagggttgcagccgctttcacaaagacacggcgattggcatgtgtctttgcaagggtggtgtttgcggtcagtgagataggcgccaaaggatccggtgtcggctcaggcacttctaggagagtctttgcagcttcaactgtggcaatcttcatcaactgcttacccacagtggttgcatcgctgacgtcgtttgctacaagtccgctctttacgtaattcttcagtgtagagagaacagatgcacccgtaacgccatccttctggaccgcgacaatctcggtgccggtgaaagtagtgaccggggtgcgagcatagagttggtctaggttaatcaaggctcgatccttatcaatttgatatcctcgatatttatagacttccttcacgacctcctcatgttgcagttcaggaaagttttcctataaatatcgcgatacccctcagccctatagactaaccatggaccaagctgcatccgaaagcctattggcacagatccttattatcgtgcaagaagtccaggtctcgatcgagagttttgaaaagcgtctagatgaagcaaagactgcaatcgaagccatcaaccgacgcattgacacggtgattgaaacaggatttccaaaaggcgacctcgttagccacagacagtggcacgaagaaaaagaccttcctgcctggaagagaattgtcctcaacctgatcctaaagtaatggaaccaatcacccctgcaattattggcggatccatcgtagccgcgcttggcggcgcgggtattttcttgcgtcggcttgcccgagacaagttagagttggtccgtgaccgtgcagaaggaaacttgatcgaggacctgatcaagcaaagagacgatgcccgcaaggagaaagcggacatggaagtagagcttcttaagattggagaagaagctgatcaatgtttggaaaaggtgaaagagctgctgtccaaagaacagcaactccgaatccaaaatgcaatgttgacacagctgctcgagaagctcgcaaccgcgttggatacatctaaggcagaacttgctgccgcactaggaacagcgaatcagtcccaggtaggctgattcgttcctttaagcgcagaccctacttctgtcagggtctcaacaaacttatctttctgatgattacactctgaacatttcagacttctgtgaacatgatattcagtccattcaaagccccacgggtcaagaatgatgtacttcttgtaccaacggttggaccactgtccccatttgtgaatgcctagacggcagagtagtctcattagtagcctcgggtgctaacttggttgctacagcaagggcaaggaacgtaatagaccgtttccgtatcgccggtgtaatcgctaacctgcttcttctgtacgtcagcaagaacgaaacgaagaatcgaagcacaattcctacaggtcgcctcacgatactgcgcttggtctttgccgatcacttcaattgccatttcaaactccttgagttggctgaggtggattattcaatccagttccggaaaccttctacacctggtggtgtcagaggccgcggcgtttcagaagcgagatacagcgcgccgatcttagctcccggtgtgccatcaatgacagctgatgcaagatagaaatgagctgtctgctcaccgctcttcaatttctctacgtcacgaatttccattcttctgccttatggtaggaggataaggtcctgagtttccagctgggcataggcttcatcaaacgccttgagctcatggcgccagaacccagcgtcatcttgatcataatcccttggcggtgaattctcaatcgccagttcgattgccttgcgccacacatctttgtgggtgacgaaattgtgatggatcgctgtagtcatcgctttagtctcagattgtcgcgtcgccgcatcagaatgttgccgaggtagttgaggccttcgccgtcgcactgtccccagaatttgtcaccccaggtattgccttcgatgaggattgcatcgcccgtgtcaagcaacttctttgccaacggcgtgccttcctcgaacttagcgtcgatgactttgaccatcaccgacaccttgatgctgtcccagttcttccagatctctacatgcctgcccatgcgctttgcttgacctgcagtgagcataggattcaggaacagatcatactcttcctgtttagcacatttcgatgcttggtaggcatgttccgcagtcgcccaaacatgtccatcgtattccatcatctcacgatagaagttagagaggaattcgtggtcgccgcggaacgaatcgatcacttccctttgaaagatatctgccatggtttagtccagatgcattaagatacacgggcaccacaggatgcagaacccgacgattaggccaatcagtgctgcaggaaagaatcctgtgaaccaaatggtgccaatgatgccaccgaccacaaagccgatgacaccgaggatcagagaggcaacaaactcgttcattccttttcacccagcaggtattcagggctgatcgccttgaacgagaacacgtcgccacggtgctgaatgtctgacttgtagacgatgccttcgcgcagcgtgtcggcgagaatgctcttgcctgttgccttgctcaggaactccttgtacgattccttcgtagcgtattcgcctcgagtcatcgtgaacagagtatggacatagcccacattctttcccgcgaaaggcttgatgaactcttccaggaagacatgtcgacccagtggcgtcaggtaatggtcatgagcaaagacatcgtagatcatgaaacgatgtgccgtcagtccgtagatgttgccctgaacgccaggaccgatcagctcgccacgaatagcaatgcgaggaatgaagtcatcctgattgaagcgagcaatccacgcagtgagcgcatcaaagatgccacttgccttggcgacgtcgatgaaggtgttaccttcctgttccagcttgaggtccaggtttcgactggtcacaccaatcttctcaccatcatggtagatggtcatcgaggagccttcgaacttctcttcggcgtggtacttgccctcaggtgcacgaccgaagcagttctgaattcgatcctgatccgttttcggcagccacactggatagttgcctgcaatcattcctgcgagctgtgccgggatcggcttctcgtacttcttgacgccgaagacaaccgacaggtcatcgtcaagctcgaaagtctgataatccggagtgcagatgcgaagaccaatgctccagtctgacgggacaggaatcagcagaccctgagacacctgaccgcgcagcttgatagtgcgcagacgatgaccttcgagcagaccaccatcctcggtcggctgcatcttgcatccacgcgccatcaagaaggcgaaacgttcgtcaccgtaaggcaggatcgaatcgatctcgaaatagatggcctggtcgccttccttgaattcgcccttcttgaccacacagctccagccgtcgacgactgccacttcaatggcatccgcgccttcaatgggaacaatttctgcgacagtgcgcagggttacgagcttacgcatatttcttccttagacctcatagtcgaatttgccacagacttcgcactggtggtgccagtcgcctgggaacattggatcgggtcgatcagtcttgacccacttcttgtgctgacaatgatcagccattgccttagaaaaatcttcgaggacaacactcaacagcccacgatcagtttcgctcatagtcttatcccggacgcgttgatcagcccaatgcctgacaacctgcagaagcgcgatctgtgcttcgagacccttctcatatttgtttagagtctcgagatgcgatttcagtgcagtggtcagctcgcgctctttctttgccaggtcaatctcgagagaatgaatccgagaatccttacgacttccaaatggccacatgatcaacccttgagtttgattttgagaatcggttcaatgaactcttcgaagtagagtcctggcatgacgaaccatccaatagccgggatcagagttggccacaggatgtgaaagagatagctaatcaggtccttgacatagacagttttcgaccaacggtagtagttcaccagcttcttcaatgctggcgggaaggccagtacaagtggccccaagaatgtaactgccaaccacaataatgtctccataccgttatgatatttggagaccatagataggtcaagcgccagggtaaaacctggcgctctagaaagtttctagttgacgttcgatcagaacggtggtgtcaatctctcaccccacttaggcgtgcgccctgcttctacatctgcctgccacttctcggtcatggtcagacggtaggcttcgatcagctccatgtccttgtgcggtgtgcagttcgggaacggagtgcgggcatgttccttgatgcggctcggaaccttctcgagcacgtccttcagatctgcccaggtcttgtggactttgccgttgcggctttcaaattctgcagccagcgctacaaagtgacggtaggtccagttgtaattgccgaagctctcccggacccagatggcgcacggatgattctggtgcgtgggcttgtagaggaccttggcccggctcccctttttcagatgatgcgcggtacagagtaactgcgcagtttcgaccaccatcttgttcagacgcaggttgtccaagttccgtgcagctagaaccggactcaggtgcgtgacgaagatgttcatgacgatctccaggttacctcaatactgcagagggttaacgtactcgtgacggattttgaacgtcggatcattgaactcaggcaacttgcaaacctgagaccggaagtgcgccttgcaggacttgatgctccgttccgcagggtactcggctacgtagaggatgtgcgtgtaggtccgggcgccgcctgagcattcgatcggcttctgatactcagcaaagaagcgcggcacatagtggaccattcggacataggcgtcaggatcaccgccctgaatcacgtccatcatcttttctgcttcctcgacgttgtcgtgttcagactggtcctgccagccaccatcgaggacttggattacgatcttcattactcggcttccttacgaacacagatccacacgtcctcagtcttgcccgcaacccgggtagcaacattcactgtgacgtatgcgtaggctgcggggttgtcgctcctccgaacccggagggcttcctcaaccagcttttcgtcacctgcgacgagcatcggcagctgagcaaaatccagtgcctgttgcgggagtagactgattcggcgcattgttcgttctccgaaaggtggggcgacttgcgccgccccgtagggctcaggcttcggtggtttcggcgacgacggcttcggttgccttcggcttggtagccttggtcgtcttcttggtcgccggcttcgcggcttcgcctgccgggacgatggagttgaagaagcggaggatgcgctggatgtccgcgcccttcaggcagaggcggcgaccacggtacttgatgaactcgcgcagcttctcgccggcggcgttttcgctggagtaggtggtctcggtcttggcaccgacttcggagaaggtcaggtccgccttgagcttgccgccgtcgttggtgaaggcgatgctggtcttccacttacgaccgctgcggctggtgatgttgccggcttcgacgtgctgcaccccggaagtctccgctcccatcttgaagccagtgactgccttcacggcaccggcgacggcttcattctgggtcttggtcaacttgctcatcttcgtgtcctttgtgtttgttgaggagtgtttgtcccacaaccacatattaagttctttctgtcctgaggacaaccttacgaatcagacacttacaactctcaggacaaaaagtcacgaattctggagatttctggtcagttctcgaggggttctggccccgtttctggacctgcccgctttccgccagcgggacgtggtctgccagaagaccccgccctcgcggacaaaccatgcgaatggcttgtttcccttgtagaaggtgaagcggtgctcgcccttctccttggcgtgcgagtagtggacttcattcgagaagtcgatctcctcaacaggatagaattcctcacggcaatgatgcacgcggagatcatagtagacagactgccacagtggtccatgaccatcatgttcatccggcgtctgtcccgggaagactttcttagccttctttgcgaagcgctcaatctcacaaacggtgtgcgatagctcgtgagccatcgtccatgaaatgtgctgcttccagttcgctctacccggaccaatgcctggtttgtcgttgaggaactcatactcgttgaaatagaatttgccggtcttgccgacgtgctgccaaacctcatgaggcatcaacatgacgaacggttcgtcgttctcgagtgatccgccccagctatggactgcattccttttccaattgaagaaaagctgagggttgtagtccctcagcttatacttcttgatcagatagtcccgctgacgtacaagttcttgttcacagaacgctgtaaggatcttacgttgttctggatgcgcgggttgtgatgccattacctacaccgtgatcagccgtttctgcgatatttagacaggtcgactgtcaggtcttcgttgtcttccttatgaccaagtcgcattgccatgttcttttccgtctcacggacttgaacacaacgacaccacacgtctgcaggtgcgccgatctcgcgaaggaagccggtgttgatgtacttgtagaggaagtccgcaatcgcttcacagccagttgcttcgacttcggtgatcttcatcagacccaggtcacccagcttcttgatcgcatcatagtgcggctcatcttgtgccaggagatagcaatggtcgaagtattcttccaggaagtccttcagcggacgcagaccgccgtagtcaacaacccagttacgagaatccaaattgtccgactcgaactcgaaatagaacgacagcgcgtagccgtggatcagattacagttgccttggtcgcgccactggcgatatgcaaccggagccaactccttgtattcttttgttgaaacgaaacgcttactcattgaacatgcctcgatgtgaatctacattacttatgatacaggactggtcacttcgtcgccaaggaacattgatacaatttgcaggttgagacggaagttttcgatctcacgagcaactcgcatccaacgcttttccttcttgctccgaccatcttcgagccagagcgcttcatctgggtcaagaccgagaagttcgcacttgtatcgtgctgccttctcgatgcgtccttcggattggatgtctcttagtccgagcgacattctggcttcacctggctacgaacacggaacgactgagagtaggcagcagaggaacactctgagacaacctcattccaatcgttgtagacggtcttctgcggaccgggcggaatggtggccaaacactgctggaaaatctgattccgcaggcactggtcgatcgtggacttgctttcttgctgaactgtgtagtcttctcggctcatacagcctgccaacgaaagaaccagcatcagtgcgatcagaaacttcttcatggtgtgtcaccttttaggcgttgacgtttaccacgtattatataggctacctgacgaagatctacctcgacagcgccgtgctggaccgccaaggctctcttcgaaagagcaatgtcgtagtggctatggacggttccagctttctgatgccactttctttggacgccaatcttgtctgccatggcgtgtagctcttcgtcggtgtcagctagcatgtggcacatgatcatcctgccatagggcgctctcatgctatcgacatagacggtcatctttcatcctcgaaactatgctggtgatctttgatgttcaacatagccttctccatagcttcacgcgctgtcttgccgacgcttagagcgccataccctccaccggaacgcaggcgcatacataccatgaagctacggtcacgggtatcactaaagatcgcctcgttccgttccatccagtcgagcatctcagtgtctgtgaacttgtattcaacaacgtcggctcgcacaagacgaacctgagcggtgccatcaaggaaggtatccgggaaacttgctagtctccattcacttccgggcaaactagcaataagagaagccaaatcctcaggagtatggcacctgatctccttatgcgtttccactttcttcagggaaggcttcctcatagtcctttgctcgtttcgtatccagcgttgcaaccattgcagacatagtagttcggatcgcgtgtcttagagaagacgttcgctccacaatcatccgccgtgcaacggaaccaacgactctcgcctttgatagtcaggcatgtgtccgaacctacgataggtagatgccaatcatcaatcttttgctcagtgataggttcaggaggatcctgttccttcagatattgttcaagcattccgatccacgtatgaatcggaattgcctgatagcctgcaccaatggcgtcccaagcacgcgccttggctttcatgtcatcaattactgtctggattttcattgagaggctcgaacctgacttcgcagttcttagaaatctctttcataccggcttcaaaatcttcaatgctaagctcgtcgtatcccatccagttgccgtccttccaaaagttcacggcaacattgaagtggacatcaacgaactcgccatcaggaagatgatacctgcctcgaatgtctttcatcgctgagactccggatagttcttgaatgcccagttgagtagcttacgtacccacctaggcgccttaaaatcgtacagcctgttcgagacagtgcaaagccattgtccaattggccagaggacatagtgcaatggatagagaacgaatacgatcagcgctgctggcagaatcattggcatcactgtccaccatcgccaattcttgaatgtcctcttccaacgtagattatcttgcggaattgtcactgcgagttctccactacgaatggccacggtagtcccaacatacgttgtcttcgatcagttggcgatgctgaatccaaccctggaagttgccagaccaagccttgttgtaacggtcgatgtgagtgacgccttcatcccagttgtagacgggaccttcagtctcatcgtacagagttttcatcggggttgcctgatgttcaaacggcgatgcgtgaaccggctttgcctcaaccagacgtcggaagatgtcctgtgccttttccagcgagtcatccagcacacgatacgacacctgagcacagcaagaagcagagatcgccagtgcttccttcagcgtgttgccaccgcgcttgtcatcgacttcctcgagttccttgccgcgtgcatatccacttgcaaaccactgaccgttcttgtagtaaggaacgtgccagtctccaggacgcagcagtttcgggaaggatgcagcttttgcctcgagcatcttctcagcgagaatcttgatctcaggctgagcatcagcgtggtttcgcagccagaagaaattgtcgtactcggttgcagttacgacgaccttgatgtgcgagaatggttccagcaaacggttgatgatctgcttgtgatacttcgcagcggcaaaggcagtcgcagcttcgacagcgcgatcgcgcgcccaattccatgcgcccaggcgactgatcgaataacgagtgccgatggtcagctggataggctcatcctgctcttcctttgcagacatgcctggctgattcttgccccaatggctgggtgcagcggtgtcttccaggatcaggcgaatcgccttgtcgatcggaattgcacggctcgatgcagcattgcgcgagaacagacgatgggtcatgaactccgaatggatgaagcgtgggtattccaattcgtaggttgtgattcgcttaccgttagggtcaatcgaatcagcaatgatttttgcagaaatggtcaaagtgttctccggttaccaataaatcgtcagcttgaattccgcctctcgctccagaggagtgtccgtatcccatgtttggaaccccattgccggatgggcataaggccccgtagctttccaactgtaggtgaatccgagcttcttgagctcctcacagagcatcttgagcaaagtgctcatctcaggttctgtgctacctgcagtgtgagttttcgagtcatgtgggatcgtgatgcctttgttgccctttgccgcttccgctcgaataagcggatccaaagttgccatcaggtcagcaacgttcttgatttctcgggcttgggcagcagttagcatccgtcatcggtctcttgagggaatggaatgattagcgaacctgacagtccgccaggcgaatcaaaataatacaggctttcggtcatcggctcaaggtcatccaggtacacttcaagaacctcaccggactcgcgctcaatgactacgattctccttccttcgcacagctgccgactcttcagtcgaacagaaacagtctcagtttcgccattgatgttgagcatcgttggcatgaaggaacaacgatagtcgaggtgctggtcagcccagtgaataaggttcatttcagattctcaggaagcggttcttgaattggctcaggaacgacggaatagcaacattctcgccgatcatgatacgataagactggctcgattgatagatgccatatccttctcgtacataccgttctgccacatcacccgctcgcagttcgcctcgaacacgacccttgaatcgctcatacagataggacagccatgcttcgtggcatgcccagatatcaaagatgaagacgtcagccttgaagtcgtagatgaagtccagctcgaggatgcgaatcagttccgaagccaggtcatggttgtcggtgacgaacgcgtactcgctgccatccaggaagtcaataccaaactcatcaacaaagtcgttggcgtaggcttcgttgaggcgatcaatggcaaactgcataccacgattgtgttcaaccacatggaaatattcagtgatacgacgaccatacagcgggtcgttgttcttcttcatttcccagagcttgtcttcctcttcatccgtcagcaggacgtcgagcttatatcggttgatcatgcgtttgctgcctcacgcagaagaacagggacatacccatcgtctcggacaaagctcttgtctaccttgaaaggccatgctgctggcttgcctgtcagataagcagccatcggacgagcgatctcggagggctgctcaaagaggtagcccattccgttctcgatgaagtatgtcaccatgaatgcgttcattggatttccggataccgatttgcgatggattccgccagacgaccttcggtgcgaccacatttgaaaatcatccagtcagaaaccatttcatggaacggcttggatgcttcggcgtggccttccttattgaagtggaatgccatctcttcgatcatcaacatcacatcagccatttcttcagccatgtgattgaagttttcgaaggtggccttccgcttggtgtacttctgcaccgcgacgatcagctcgcccaattcctcgacgagcatatcggtctgggcaggcacaccccagtggtcgagacagtcagcgtagagatcttcgcgattgactcggctgagccagactgcgccggtcaccgcagcggatccggcttggtggcgttttccaggttctggaatacttcgcgtagcgcctcgacggtgtaaggttccttacgatcgttcagggagccacccagggtgacgacgtctgctgccaacttgaccggcgaaactgcaacgccgacggctgccttaagaagagatccaaacatgttcttttcctcagtgataggtgatgatctgatcgatctcgagctccagggcctcagcctcgaagtaggaaatctcacggttgagttctgccagagcagccttgttgatcgcctgatcttcagcgatctccttgatgcgatgacggttgtgagcacgagcatggttcagctcacggatggtacgaaccagctcgtcatagatgacgtcgccatgattcagaccacgggcacgcgcgtcttccagtgccagtccgacacgcttgatttctgccttcaaggtcggcagcatcacttcgacctcgtgacgtgcttcatcgcgcaggtcttcgatcgaattgtagacgtgacggcgagtctcgatcagatgggcgtgatgcagggcgtccagcatttcagtggctttctgtgcggcgatggtcatgatcaaataccttttcaaagtgtgtcaaagcattatacagcggtgtaaggctttctcagcctacgaatttttgctcgattgctgccttgcggaaggcaaccaacttggcctcgtcggtttcgttgtggcagcccattcgcttgcaaccgtcgacgaaacctacgcctgagcaaccatcgaaaccttccggttccgtgttaccaagagcgtcgatcgcttcttgatagaaagtcgtgtccattatttcctcattactgattctagttcgaaagcagatttcaggccagaaatagcatcgttcgcctgcatcaccgcccgtacaccaaatggtgtcgccgacacgtgctgagcctgccatgctaacagccaggcgtattctcgcacggtcagctcggtcatcggcttgtcaagatcaattagcattgaacattgcctccatctgtgcctggatgtgaccctcacggtaagcgcaattcagcagctcaaccacttgtcgtgctagactttcgtccttcacttcgcggatcacagtttcatcgtagacgatgtcgtaggtgtcccagaagaaaccaacctttcgggctcggtagctgtagggcttgcgcttagtgatatcgaatctcattcttcgtagtccagtaggtcaggcttctctccaatgcccagagaatagttgacttcggcggcggtgaactctgctcggctacgactcttgaacatgaagagagattcgttccgctccggtgtgcccaacatgacgtagtattccatgccggcggaagtcttcatgtctgcaacgaaagcctgaggctgctttacagccttcgcatccttgatcgcattgatcaagaacatcagaccttgtttgcccatgaaccactcgctgggattgccatcgctatcatccggaagaagttccagaggatattcgccacgctctgccagactcagaaagacattgtaggcatgggtggcggcttcgatcagcttttcgagtgcggcggcctggctcatttcactgtaccttgatgcaagagagggattggtcaccgtacagatagtggtaacaaaccacgccgtacttgtctggtttcgagaaggcttctactcgatgctcgaacgatttgttcgtccagggcgaggtgacggtctcacctgccgcagcagttgctgcctctggcggactcggaagttcctggcgcgaacatgcggtgaggctcagagccagaagagcgattgagagaatctttttcattgcttgtcccagatggtggtgtcgaaaactcggcgctctacttccaggaatgcctcgaccatccattcaggccagatcggtgtgctggtaccgaacagatcacgggtttcctttgcggtcatgtagccgaagtgctcatagaactttcgagccgcagccatataaccatcgcggtgcaccatgccttcagtatatgcggcttggtcagaacgacacaccatcaccgcaaagaccatgacgccctggaagaaaatctgcttcttgttctcgatcatttctctgcgttccggagttcaattgccttgagggtgttcgcttccaccaggtccatcgagatgtccacgacttcgagaacgagttggtattgctcttcggtcagttcgcgttgcaggctgatatcaattgcagctgctcttgcgatcttctggatgatttcgtctttggtcataccggcaccgtctccatccgcttcttacgacgaaccttcggcttcttgctcaggaacgtcttgggtttcttcttccccttccatgcccaggggtagttgtttgccttcggggtcaatccacgcgctgccagcttggcacagtagtcgccgtagcgttcttcgtctgacggtacaggcggaacctggatggagagattgccttccatacggcgacgggtgtcaatgatgattccttcgcgcatcaacatctgcataaacttgtctcagtcctcgagatagggtttccactcttccgggaagctcatgttgctatatggagcgttccggaacagaggagcgatctgctcgtcggtgtagcctgcgaggccacaaccgattcgagtaacgaaataccgacgggtgttgaagaggtgaccagcctgacgaatgaattcgtcgatgtgaggcttgatcagttcgagcggcagggtctggatgcgttcatccttggtcggaattgcgtaagaccgaccctgcccaccaataccaacgccatacacggcaccatagtgctcgagtgcggctcttgctgcgcctgcaccatgccgaccggcgaggttactgccgaagacgaaaatctcgtccggtgctgcctgggtgccgtctttatggtaggtgcgcatcactgttccttggatgaggtgttcacgacggggcgtgtgcagctcttgccgcaattctcttcgtaggccaccgatgccgaatgcgaacagtctgcatagtagacgtagcgaatgttgccgtcgaggaatcggtagaccgtgcagccatccttgacgaaaagcttctcgacctggatgccgttctgggtatagctggcttcttgtggcggcgaatgctcgaagcatccggtcaacccgccggcaatggccagggccaatccgaggacgccgtagaggctgccgttcttgatacgcatgctcattcgtcaccttccttgaccttcttggccttcggagcgcgcttgagcgaatccttccagaagacgtgctgcacgccgttcacgttgccgtagaacttcttcagttcgtaggggaacttcgagacgttggtcaccttggttccgacttcgatgtagaccgtctggaatccatcgacacgattgccaacatacgccggcaccttcgaaagacccttgacctgcggaacgacaacatactcagacatttcggaacctcttggagtgatttgtttttcggaactgtttaccactcacacagtctacagatcaggcacttctggaacaaccttttcgtaggccagaaagttctcgattgacgcaagaaaagccacatttctgtggcttctcctacttgcagaaagttttcttactgcacgagcaccgaagtgccaggcggcgctacgatacagctcttgcttgccttacaggcatcggcttggatgttggcaatctggagacgaagatactgctcaggagacagaagcatttcgtttcggtatgcgttgtcagcagctgccttcgaaatctgttgctgctttcgagcctgttcagccaagtcggcttgaaccatcgtcttggcgcgctgctgctcggctgctgtcaggttcatctgctggagaacatcgggattaggcttagctcgtcccagggagacatccatcaccacaacattgtcacctagcttttccttgaccagtgcaatcagcttctcggtcacgtcggcatctacttcctgagctgtcttttggccagacatcagttcattcatgtccttggtcttgacagcatcgcgaacaatggctcggtagttagcctggatgttgttcttgaaccaatcaggtcccttggtcttgtagagctgagatgcgttcttgacctgtagctggatgttcgtctcgaagtccagaaggatgttgtctttgctagacaggtcgtcgaagttcacaggaatgttctgcggagtgacgtccacatagatcgcctccgtcgtaagtgccacgaactcgcgcccaggcttgacggtttcatccagcacgccaccggtgccgaagatcatcggcttggcgaccagaacagcttcctgaccaggatcaggcgaaaccacagaacaaccggtggtagctagaacagcagccatcagaattgctacaaagaacttcttcatggattaattctttcctttgactttacgatagatataggcaacaagaacgacagcaagagtcaggccaatgatagaaccccagatgccagcaacaagtgcaaccggaatccacagaggcgacgttacccaccaccaagaccaacctgcgacgacaccaaccttacccagcttaagaccgatgaacaacagtgctagcagaggcaggaaaggaacgccgaaccttatcgagatatttttaacttcactcacatacttctccttaggctgcaaccttcaacagattgcgatacatgtcttgcttcttcgagtcaccatgcccgacataagcatcccagaattgacgagacggatcgcgcttgcctgtaccatgtgtgaagtgctccgtaatcgcacacagcgtaccgtacgccgtgcccttggagtaaccggacccactaccacccagagccagatcggtcaaacgcgtaacttctcggttcacaccccaggtttgttcgtctgcacgacgttctggattgtacagctgctcttcgaagaactctcgagtctgacgagcagacatcttcttgttcgccagtttccgcatgttggccatgaaatctgcccaacccttgtcgatcagcttgagatcgatcttcacctgggtcggatcgaagtccttcttatgcgtcactcgaatcactggacgagagcttgctccctgcagagcaatcgtcagagtgttgttgcaaaccactcgggtcgaggtgaaacgcgcttgggtcgacatcgttccatccacagccgttgtcagcagcagatgtccgtcaatctgatccttgtcgataacgttctcgctcttgccaacatctgcaagtgcccagaaacgacgaccaccaaagagcgatccagctgtactaagtttgaaaccatgcagttcaacaaggtctcggaagaactcgatgacctgatcaggctgtacgatcttgaaatcattcgagacaatgcccagggcttccttgttgtccgaacggaacagaacgcgcttgtccggaatcgaatgcttctcaggcttaccctttgcacttactgcggtgtaatcgacagtggattcgtgtacttcccaatccagacctgccatgcgcttccaatcatcgaaggaagcattttcatcgacctgctgaccaagtccgtgccaaactgcgctgcgaggaccggtaaacgccatttcacttgtgccgtctgcacgttcagtaatttcgtgtgccatctaaatcacgtactccaataataaagtgttaccgctaccacactcacagtctacatctttgacctggataggtcaatcaacagcttgaactgtcccaagaatgatcttcgcgagcgtcgtcatagccttcctgccaagcctgttgccttactgcttcgacgtcaacggtcgtagttgctgtttcccagagatcattcagcacaccgtaaaggtgagtgtcctgttcttcagggaatggaatgttcagcgctgagtaaacggttttgattgcgtttaccttaaggtagacgtctgaaaggcggtcgttttcaatgtccgaagtcaaattctattcctccatcaagtcggtaggtccactcgccacagccaccagaagtggtgtagggaacccatccatagggtttcagcttaaggtaaagccaggtattgaactctcggcggacgcgttcgtgttcattaggccaggtgtgcaagtctacggtgaggtagtacccactcgaccgcttcttgaacttgaacgatgccggcttcctttccatcaaaggatggttagtcgtaatgaacggagctgccttgagctccgccattaccgccttatagatttcagcgtttgtcatcttagaactcgatgtagggattgccaacctgcacgacgttcagacccaggtcacgccacatacggcacacgctaggacggtcatccagaacgatctgcacgtcgtagttgcccaggatgaactcgcggaagatctcttccttcacgatcgtgtccttacgctgatccgaagccttgcgcatcagcagccgacaaccgcccagccagtaaccatccggaccgaagacgttctgcagccacttctcggtcaggtcatagcattcatcactgcgaccagaagtgaacaggatgaagtgcccagctgccatcagccccttgaccatatcgatgatcggggtatgcggagcgtccaggtgcaccttgtgccactcgaacggaccacgaacaccttccatcagagctacggtaccatcaatgtcgacgatggcagccttgataccgtcttccggctgcttgatgcgaccaacgtgctgatcgatgaactgctggtgctgcttctgcagaacagaatagccgacaccatgagcacgctcgttatcgcgacgaacagcttcatcccaggtcacatcgaagaacttgtattcgacggtgtaacccaggccttccagcttggcagccatcgcgccacgaacgttctcgttcaagttcgtatcggcgatgatgacgtccttgccctgagccgcgcagagagccaggtcggcgtccacgcgttcagtgacgagattttcccacttccacttccagttggtccaggaaggcgagatgcccttctcttccatgatggaccaacggtagttgtcgcggctgatcacttcacccggctggtgcagagcccaggtagtcttacccgaggcagacacaccgatggtcagagttgccttcattacttgatgctccaatcgaccttgccggtctccagcagattgcggatgacgcgagcggtcttgtaggggtcgttgaaatccgaccagttgcttccgtcggcgtagatgccactcgcaccaaccggaatgaaaaggtcgactgcggtcttatgatccagttccagcaggtcctgcgcttcatagaagacagaatcccactcggcttcattggtagcatcatcttcctgccaagaggcaaagttgaaagctgcgttggccagctcaccgtcttcgtcgttgaagaactgcgttgctgcaccggcgatgcagcaggtggttccacaggaaggtgcatcgctcttgagcgcctggacaccgacggaaatgtcgaagcccttcaccttacccttgtgcggcgcgccggcttccagccactcggcgatgtagatcagacgttcacggttcatgatatattttccagagttgagttagtacttcacacaggagagattctgaggctcattgtagggctgaatccagtaacacttgattctcttctcgaggtcatcaagcatgtagactcgctcaccatttgctctcacgtcggtttgcacatattttacagcaggtgcatttcttgtgaccggcggtttcggtcggctcggttcatttgctgccgccatcatcgactgggtcagcatctgagtgttcgtgtccatgatgatgttctgcgccattgcagacagcggcatcatcagagcgaatgcgagaagaatcttcttcatagcggcaggcagctaattgccggaccgccaccatggtagacatacatcttctggatgtagcataccttgcgcagttcgtagtcaacgaaacggatcaccgaagtctcgcccttggtcgacggatcagggatctgcgtgaacctgaactgattcacattggcctgaacatacgacggaaccggcttcggctggggcagctgttctgcgttggcgcccaggggtagcgagattgctaccccgaaggctactgccagcgtccagaaagcaatgcgcttcttggagatggccatctcttacttcgccttcaccggcaggtcggtctcgacgccctcgttctcagcagccaggtcagccttgctgtagaacttgaccggctcgctcagatagagcgacttgatggcgagcttcgcttctgccgtcggagcagtagccaggtagcgcttgaactgcttggtggagatgcgtgcaccaacgtaggtcttggtgtccttcttttctttcacagccattgcggtattacctcttgttggattctttcgagacaaagattaccttgtcccagatggggtggttgtagatgaaatcgacgatgcgctttgccttgggaccgaaggtgacctcaacccactcggcaaagataaagaatcctgccagcaagttaaacaccgggatgattgccaacaagcacatcaatccgaagaagcccaggtcgcctaccgtgacctcatgggttttcacgtggtagatagcttcctgagtcaggtaggcgaggcagaagatgcttccgaatgcccagagtgcgaacaggatgatttcgatcatgacttgaatccgcagacaggctttctgaagaagtccctgatctggcgatcatattcaacgatatgatagatcgcgatgatgatcagaatccaccagttgatacctgggattgctgcgccgagaaggattgcaggaatcctgagcactgttccgatggtcagacagtcgtagtactggatgtcttcgaccgccttcttccaggtatagtacccgcctacgatgaggaggatgagcgcaggaagcgcccacccaaagataagcccaatcatgctgccatccgcatcgcgaccggcgtaccgcccggattgtcatcgtcgccttcggggcgattgtcgtggttcacgaactcaggctgcggaccgacttcgatttcgatctgttcgccctgcgggaagtcgaaacgaatgaagcgagtcttttcgttccgcttgcccaggtcatacaccgagacgccttcggcgccaacggcagaggaaatcgcccgcagatgttcgtcaacgacgaacttgtgagcttcactacctgcaacacgagcgacggcagcggagatcaatgcaaccttcgcgccgtccaacctgatcatcatcacaaagtcctgtttggttaccgtacaattatgatattgtttcgatgtagaaagaacaagttcttacttgatttccttcagctctcgaacgtacatgtccttcgccgtatctttttcgagggcaaccagggtagatttttcgttgtccgttgccttcgaaagttcttcgatcttatctttcgtcaagttccagataggcatctgcaacagtcgatcgtagtcttcgaacttgtttttctgcaacagttctaccaaggcatccttcttcaagttcttgaaggtagccgagttgtccagatagaaaagaatgaagcgcatccgctcactcagccaacgaatcttctcagccgttgcctcgatcagtttctggcgacgcttctcatagaagcccagacgagcctcgacgaaatactcgatcagctgttccggagtgtcgaaggtcttgatcttacccttgtgatcccagacaacgatgttctcagactcacgagagatcagtcccagcttgaccatcaggtcttcgtcagtctgagacttcaaccattcgcgcgtcgtgtagagagtgatcttccaaccagcctcttccgtcgagtcatcgtcgtagtccttgatccagcccttatcaatgagcttcgacaggtgcgactgatacttctcctgttcgataccaaccggcagttcagtgatcagaatagtcgtggtgttgacacgctcaaacttgccacggaacgtcgtctgcccatcgaccttcgagatatcgcccgtccaacccttgtaccaaggaaccagcttggtctgcttcttacctgcgagaacctgctgcacattgcgaacaacgtcatcaggattgtagttcagaatcgtacaagagtaaccagtaccgatgccctcactaccgttgaacagaattgtcggaaccttcggaatgaagaacgttggctcaatctgttcaccatcctcaaactcgtattcgaggatcaggtcgtcgtccttactgaaccacttgcggaagttgggcgaaccctcaaccgagatatatcgtccagacgaagccttgtgatcaaggatgttaccgaacgtgccatctggaatgaaccaattgacattgttcgaggttgggaagttctgcgccataccaacgatgacgccttccagattgcctgcaccatggtggtatgcagtttccgatgccacctgagccgaatatcgctcaacggtgttgagcttgttcgttcggttgatgacataggcggccttgcgctgactgatcttgaaaccatcaatcatgttcggaatgttgatcgcacaatcgtattccgagaatgatttgaagtctcgatcgaggaagtccttcactcgcagcttagtgatccccgacaaatcagtcggggtcgtttcaaaattgctatcgtcgtcgaaaaatctcattccagatccagccattccttacgtttgtcggtgaaaccagcttccttcaagaagcagaggtccatcgtttcctttgcagcgtcatcgaacgtgaactgtaccagataacggtccagattgtccatgtacttcttccactgcttcggagacgacgagccaagtcccttcaagaacttgtagctgtatttctcgttctgatgctttagacgccatgcctcaaactcttccatcgtgaagaattcgagatcctgcttcttgtagtcaacagtgaccacaggagtgacgagacgatagatctttcccttcttgacaaggtctggccacagtcggtagtacatgttcactaccagaccagcaatggagtgaccgaactggtcagcgtccgatgccacaatgatacgtccgaagtttagattgttcaagtccggagcttcgccgtacttcaaaccaacgacaattcgtgcattctcgaactgatcgttctcttttaccttcgccagaggtgcagccgacacattgatcgggcgaccgcgcagagcaaagatgccatgcagcttcggattacgagcacctcgcagaggacctgctgccgagtcaccctcagccaggaacagcgaggtcagatgacgatccttcttttcggttgcatcgttgaacttcggaatgtgcttcaggttcgccttatccgttgccttgttgagcttacggagctcacgcatttcttcctgatgagcctttgcagctgcccaatcaagtaccgactgaatgatcgtcgacttgatgatcttgtttacgaacttctgatcaatggtccagctcgtcttgaagtccttcacctcagtgatcaggtcttccttcgtctgagacgaatagcgaggattgacgatctgagcatcaatgaacagtcggaagtgctgcttcaactccgaaggcttgacgtcgatcttgtgcttcttcttgatgtgagcacggagctcagcacaaatctgattggccacatagtcgatatggctaccaccagtctttgtgcgagtaccattgacgaatgagatatgagcgaacccatcctcagcaccagcgataccaatcttccagtgctggttttcatcgtaggcatactcaggagtgaacatctcaatgtagtccttgaaggacttcaaattgatgcgactaccattgagatagaccttgaggtgagaattcgtagctgcaatctcatagacacgattgacgagaactgcaatgttcccttcatcaatgcccttcatgcccagcttttcaaagtcaggctgataggtgatctttgtgaagccacctgcacctggtcgaaccacaggtgtcgagcgagtctgcgagttgtccgagaactccatcttgaacttgtacttgccgtcacaagtttcaacaatgaacttcttgctgaagatattcgttagtgctgcaccttcaccgttctgaccagtgagcatcgactcgtcagcatcattgaagttgctacccgaacgaagctcgaagatcatctcaggaacgtactgattgtattccttgtgcttgatgacaggaataccaccattgtcgtagatagagatctcaccagtggagtgatcgatatcaaccttgatggtatcgagattcttgccttccggacgcttcgagtgatcgacagagttagagacaacttcatcgaacagcttgaggaagccaggattgaaagtcagctcacgctgctccatctttcccgaagtcgggcaatgttccacagaagtgtgggacgtaatgctcccgatgtaccgaccaggacgaagcagaacgtgttccacttctgacagttttctaaactgcttttcgattgttttcatgccttctactttttctttctttttgaagtttcttttaatgaatcttgctaccgaagcattatacaggaatcagaaagtcggtgtccacagttgcttagactatgatctaactttcgatagatcaatatccaatgggacggtaacgacgccctcaggcatatttcttgccatgtaggtgagggcgccaggaccgatgaactcaactaaccgattgaaccaagctttgtctagtacgacatgctcagatcgttgatcggtagtcatgcttcatgctcggcttggtttctaccggatccaatgccatgatgtagtagtcagggactacagatttattgttgtacttaagattgtaggctgtctggaagaccttggcttcctcgaaggtcgggaaaggaccagcatagccatcaatcttggaaccccaaccacgctcactttcatacataggaatcgagtaggacatttgattctcctttagcagccgaagttggaaggcagccagaagtgatagttgtcttcctggctgtacgggtaatggtcgagctgtgcgagttggacgatttcatccacatcgctttcaatgccctggcttccgtaggtgtagcaacggagatgcttctcagcatattccatcaggtccttacccagctcacggcgaaggtcaagagtctttttctggatttcttcagcgcgcttgcgcatacttcccagaactgctctgtccttctcgatcttttcaggagtcggtgcaccgaaaacgtcgaagggagtttcaacttcccaatcgcccttctcgaggcgctccagactctttcgcagctcacgagctacagcttcggcactgccagggttgtcgcccagagtaagaccacccagggtcattcccatcttttcaagctgagctttcagcttttcttgttcggtcggcttgttttcgttttcagtgctcatgatgtgtccttgttgggcggtttgccatgtgttcaactacttcttcccacgaccatggtaacaggttgtggccatcgactccaacgtcgagaatcttgccaggaatgccagtcggcttgccatggacgtgtccgtggatatgccaccaccctcgatggatctgcatccattcccagattgggaagtgacacagaacgatttgctggccctcacagctgatctcagcatacgaatagggatagatctgtgtccactgagaacggaacttctcgtccttgatgtgcttcttgtcgtggttgcctggaatcaagaacttctggccattgaggcgacgaagaaccttggtggacttttcaatgtcccatccgccgaagtcaccaacgtggtacacgcgatcctttctaccgatgcgagcgttccactcggtgatcatgtgttcatcgagctcatccacgtctgcgaaacgattacgcccattggggtaatgcttcatcagatttccatgggtaaagtgcgtgtcagaaataaagaatgtgttcatgactatatgatataacatcaatgacgaaacaacaccaaagaaaaacccgtagaagctttcgccgctacgggttctttctattaggctactacgatgccgtttgcggtcagcgttgcgtcggcaggagtgccaccttcgaacgaaacaacagcggtcatgctataggtacccggtgcaccaaagacgtgctgatagacaggaccgccttcaactgctgcaccagcctggagagctgccgtagcagtcgcgccagttccgtcaccggagatggtcacagttggagcagacagatatcctgcacctgggttggtgattgtgatgcctgttactgcaccgcctagagtagcagttgctactgctccggaaccgtcacctgtgaaagtgatcgcaggtgcagtgacataggcagtacctgggttagtcacaacgacagcggtgatcttaccacccatgaccgacgtcgcggtagcgccagtaccgtcaccactgatggtagcggtcgcgactccggtatagccagagccaggattcgtgatggtcacgccagttacagcgccacccgaaacggtgaccgtacctgttgcctgagtaccaccgcccggaggagcggagaatgcaacggttgcagcagtgtagccagttccgccagcgccaatggtcacgctcttgacagagtccttgacaatggttgcggtaccggtagcacgagtgcctgggccagttgcgaagctgacggttgcagtggtgtagagagaaccaccgttggaaacagcaacgctcttgacacgatcacgagtgaccgtcgcggttgcagttgcctgggtgccgcctgcaggaggagcagagattgctacggttgctgcggtatagttagtaccacctgcgccgatggtgatgcttgccagaggagatgcgcttccgccagtctgccagcttacagactcaatcttgtcgaggctgtggatagcgaactgaacacgcttgccgtgagcaacgtaattgatcaggttgcgagttgcaccgtccggatcaaggaacgactttgccttggcgtttggcttgtaaaaatcaacgggagtttcgccatcaagctgagatgctggaattgcacccgccgtcagctgttcgccggtcaacggatgtgcccagccgatcgcggttggaatggcttcagggagaaaacttagtggcattggtaaatgtcctgtgtgatgtatccacagtatttaccctttacgcacgcagtcttcccagattccaatggcacaatcaatgagaagctctatgacgcatccaacgccatagagcatatcataggcaaactctttgagagcctcagtcaatctctgcattttcgattgcacgattgatggccttcttggctgccttggcatcctcaggatcttcggcatctacggcgttgtaatagacgtagccgagctcttcatccatagccaccgagaactgattggcaacatccagagcattctttgccttgatcaggaacacatagtcgtcacctgattcggtctttgcagccacggcatagtatttcagcttatctttcgacttctctttcatatcaatctccaaaccattcatcaacggtgtagacgtagatctcgtcccagtggccatcatatgtcatatcgccaaggaagaattctctgcccttgtcatcaactaaggttacagcgtcgagcttatcgagtgcctcaaaaaattcgtcgtaactgatttcgttagctgcgtacttcgaacgaacctcgcgagtagccctttggttctggacatactctagcttcttctcctcgagcttttctttgaatgcttccttggaagcaaattccgcaggttcgatgaaggtgcgagtgtcatcatactcgccattggtccaatcaagaattagtcgcattcttctctgccttgtaacgttcaaaagcctccatgatcccttcctcaatctcagatgggaacatgctatacactttgtcctcaggcagcatccgcttcacaatctgcattagctcgcctagctcctttccatcaagacctgtcaactcgcgaacgatgttaccgttgagcttagccttgacttccttgcgaacagcattctggcaattcaggaacaggatctcacttcttaggtgaggccatttgtctttgtggcgctcaaggtgctttgccttatccgaaggaacatactcgccatcgaaggccaggcgctcaaggaacatgttgtacaccttgcgctttgcatcacggacacgcgcctgatgattacgatgctcaagtgggaaagcactcggctcgaaatatttgcaacgctcgacccaatcaaacatctgttcgaaggagtcaaagcctgcgcggtaatcgttgacgtcaaaaccaagatgacacagtgcagtgtcgtagtccttggtcagcggaatctcgcccagctggtggtcaccatcgcgatgcacataccacagaccatcatggccatgtttcagaccttgacggtgtgcgatgcgcccgatcagattgcccaggtcgttccaagagaagtactggaacgcaaattccatgtcttcatccttggtcttgttcaagtcaacctggatgtactttccgtcagtttcgatcaacagattgtagccgcaaccattggagatttcacctaccacccggaagccgttcttcatctgtttgagcgcagcttgaatctgcgagctcgccacaagaacatcgacgtcgccgtagctttccttgttcctcacagaatgaggaatggagaagcctgtgccgtagcccatgatgttctgcaggagccacttgatatcgtccacgacatctttgtagaactgcggtgtcaggcgttcagccttatcaaaagcgttgccgcccataattactccttctcgtagccttcctcttcggcaggcttctccttgagaccgtcaacagaccatccggtccagccgacctgcttcatcttccatcggtagttatccgatcctgcccacacgcagaggtgagcgaactgctcgacaatgctcatcaaattctctccagcttcatgattgcttcttccaattcatccgcgaacttgttcgcacccttttcatttccgcgccacgaatactcgcgacccagatcgccatgctcgagtcgatgcacgatagcttcgagcgtggtttcctcaggttcgaactgtccttcgagtccatagcaggaacagtggctaccgttcacttcgtagtacttgccccacttacggaacagaacgaaagcatcgccttcatatccggaggtttcgtagtatgcaaggatgatttgagcgtcatcgagatagttttcgatgcgctctgcgcctacacggttgtcgccattgccgaaatcgtaatggcagaaatcctggatcatctcctcacggttagaccaggagcccataaaaatgttcatagcaagatatcccttggttgatatggcggaagatgcgcaggtcgctcagctgggtagccacgcggattacagatcacttccgtctgaccgatagtatagttgatgtaatcgtgcgtatgtccgtgaacccaatagctgaggtcagggaaagactcgatcagcgcatcaaagtgattgcaatacgctttgttcaactcgtaatcagcacgaaaacggtttggcacagattgcatcgaaggagcatggtgggtcatcaccagcttgattccgttgctaggcttctcgaggaagtccatcaacctgttcttgcccttcatatgctcgatcaggatatcgcgcggagtgatctttcggtacccagccttcttgatgcgaatgttcctaaaatcattcaggccaaggaaggcagccatctcagcgatagggctaccgtgataatctgtccacagcgtgccaccaaagacatcaaggtgaccaaacgacctcacctcattacggagcggaatgatattcttccactgctccagatagacgtccatgtgatcgtcagcaacatctagctcagagcggtaaaactcgtggttgccggagatgacgaatacttgttccgccatcttggagacgccgtcgaagaactcagcaccgtgcttccgcagatagtcttcctcgccgaggtcaccagccaggagcagcaggtcgccacgccactggaagaactcggggttcatatctgcaaaatctagatggagatcagacgcgactccgactttcatacggcacctcatatttctgttgtacgattttccgaagcttttccttggtcagtatcgatttcttgccggcgcgagaaacagaatacgacgcaggaatttgaagatgcagcttcggaacgtagcgtgcaccatggtacttcatcggcttgagcgttccggtgaccttgagcgagtacagctgctcttcacccggatgccagaagtagccatcgtaattcggaaccgctaccagttccgtcggaattgtgttcatgctcacaggtcagacctcagccaatgtcccaacttagaattgtagattgtctcatatgtccagacaagaacgagaaccacagacactaccgtgttcccgataggtgcgagcgagatacctgcacccgtaaaccatgtccagacataattccacttggtagctttactccagacaccgcaccagtctctgtagcgcttcgtttccttgagggtctttatctcttccctccagatgtatcgtgcaggcagaggaatcgagatgaggtagacagcaaggaagatgaaaaattcgatcacagctttttcctcagccaatcaccgcacgcccagtcaatggtcgcaataagcgcaaagataagcccggtgcctgtgaatgccatattgatgacagggatgaaagtaacagccagagcgattgcaccacgacgaacaagagttccacgggttgctggcctctcaacactgtaaacgaaatccatgaacttcttgttcttccagatttcacgaagaccaatggcacagacgattccgttaactgcaacagctacccagtaaaggatcaggaaaactgtcgcttcggtcatgcgaacggcacctgatactccgtcggatacagcgactggagctccttcttggccatgaacttcttcttgccaccgacggagacagcccagccatcttcaccgtacgacttcttcgcctggtagcagccgacctgcttgatcggcttcaacttgccagacttgaacgagaacagctggcgcgaattgcgatcgtacaggtagccatcgtggacggtctgtaccaggtgcgccgggaacttcacgcaaacttcgttgctcattatcaattttccttcaaaggtgtataagtgctacacaattatgatatgcaggatgcctggatagaacaagatcagtaagtgaacagccttgccgaagaaaaattcttgatcacgttccagatgaactcatactcaaacgaatcttcatcatagtctcggaggtagtcatacttgcagaaaagaccatctgcaagatcttcgcgccaacttgcgatagtgatgtcgaaggctttcttaccaaaagcccagccgttcttcgacatgtcgtggttgagcccgaaagtttctttctcgaaagcttcgagcaaagccttctcagaaaagtccagcgtgcaatcttctggatgatagaaggcctcggctacctttcggtaattctcaggaattgatcgcatcagagtacatcttttccagttcttcgagtagatcaggtgagtgaaccatgacaatgtctttcggaggacccatcttccatttctggcgccagacaaactttcgtttgccatggcgactgactcggcgacgatcctttagcctgcgagcgttcgcagtgactggaattgttacaacttgaatggatacttcgcgcatattaggtccacatgtgcttacggagacggatgatttcgttcatgtagaacgtgtcttcggcttcgagtttttcttcggtttccggcttgtagttggtgtagcagtctgcccagaatcccttacgcgtcttagcccaacggtagcatttgtcgaggtcagcgtacagcttacgtcggcgtgcgtagtcttcttggtcttcggcattgagtgcctttccgccgcacgggccttcgtagtactcgaactggtagcgagtcgacttctcgccattgtcctcttcccagaagtggatcatgctttcgaagatggcggtttcgatgatgaagtctttgtctacgaaacgtcgcccgatttctttcgtcaaccatttctggcgcggattgagccgggtgtcgatttccagccagaggttcttgaaccagtgtcgtacgtcgaaccacaggtcttcgagctgctctttcacgtcgtgtctgttcattgctttatcctataggtagatcatttctattcaaccaaagaaaaagccaggaccgattaaagccctggcttttgacatcttggagcgagcagcgagattcgaactcgcgacgacttgcatggcaagcaagcattctaccagactgaattatacccgcaaaggtttagccttcgccaacagcagtgaagctcgttgtatctgacatatcattttcctttgtttggtgcccctagtcaggatcgaactgacgacctcttccttaccaaggaagtgcactgccactgtgctataggggcgaatttgttagtaccactcttcaccaaactcacgcttttcccaaatgatcagagatttagaatgagtcgaagaagttgtgcttcgaagctcctcaactactcgatcggcatcctcaggagttgcctgaatcgaatgaatatgtgaactacgaggccctcgataagtcttatcaattacgacgtaaagcatcgtccaccttatctggcggacagcagagaaatcgaatcccatacctttcggtaccaaccgctttccaagcggtgctgactaccaagtcagattactgtccatatgttctatttacagctggaaatctttcaatgccatatcagcgggatagacattgttgttctgcagagtcgagcggcgagtagctgggatcttcttgtactcgtaaccagcttgaagctctttcttcttcaagttgtagcgttcctgttccgcatgatactccggtgtattccaacgagctctcggatatgggttttgcttatactcagcattccaatcgtaatgcttgccttcggcattcacaaagatggtcttgatgtaatcaagctcaacgacacaatttcccttgcgcttaccaaggtaggtgcctgcgtgcatcttcgagcgtccggtggacgtggtcatcacgatgcagcgttcaccaggcttaacaccattgtgttctacagcttcaatcggtccactacgactcataatctttccttgtttggcggacagcagaggtctcgatccccacaccattacgtgcctaccgatttcaagtcggcgctagctccccggctagtttactgtccattgttttggcggattgctgaggtctcgatccccatgcccctttcgggcacctaccgctttcgaagcggtgccaactccctggttggttaacaatccatacgtgatatttatcggtcagcaacgatcgctagagctgacccaatcaccaacttcaacaccaacttcttccttcagatattctaccatgtcttcatcttcatgatcagggaggaacacatcataggtatggtagttgatggagaaagagaacggggtgtttgtctctacagcgacatcctgaatctcgcgcagcttttcatacagctcttcttccagacgttgcagcttagcattgctcatgatcaattttccagttggttgattacatcgttgaattcggattccggaatcgcttcaaagaggactccttcttcctttgcctgacggtcgaacgagttaaacacacccgaggtcgccacagtcaaagtataacggcgaatggcttcttgtgtaggcaggacataagtcgaacctgatcttgtttcaacaactacccaatcgccatcgaactctactacgcgtttcagagcagtgctcagacgccagctatcgccgtagagatagccaccgctccatccaccaagcacatgaacgcctgcagaggtgcgaacgaggatgaagctatcaggcttgttgcctttttctggtgcaaggtcttccatcattctctccaactgccatagtcatagacagtttcattgatattccaatgcttgaacatcggatcatctacattgatgaaacgcaccttggcattgcctttggtgaattccatgttgtgatcaaccacgtcgtcaatcagagtaacgcgagcattctttccgaaatgttcaagcctcagcagctggagtagacactcttccttgccaaacaggtcaaacatatcgtcacggctaagccatttccgacgtcgcttaaggatgatgtctgagaagtcgtgcatagagaagatgagttcttcggagaacttcatgccaagcatttcttcgagtggaccttgcaggcgcttcttgaacgtctctttgtccacttcattccatacagcccaagacatcaatcccagcttgcagccagtgtgctgaattgcccagcgaatcttatcgaggttgcctggaagcaggttcatgtgctcccaatcgtcgatcacggtttgctcaagatcaagcagcacaattttcatgatcacatcactcgtgtacgtttcccattttcgtcaatggtgacgatggaagctgagtgatagttctcactctcagcccattccaaagcttcctcgagatcgggtgcccagaatgcaatctgaccttcttcccaatcatcgccgtaatcatcaatcactgcatagtagacaatcatgatcaactccaaattggcggagcgcagaggtctcgatccccagacccgttcatagggtcccaactgtttagcaaacagcgtcagccacctggctgagttacgctccaatgtttctacttaccgagagtttccttaaacacgtcgtagaagtaatcaatggctgcctcgtcgagtttttcttcctcaacgaacaccaggaattgctcagcggcgtttctcaaaatctcgtagttgatgtctgtgccggcgctctgtgaatcgtagccgtatgcagaatccggataatgcaatgcccaggcttccggagaagacatgaaggtaatgccttcccaggtatacatgatatgaccatcatccaagatttcagtcacttcaacaacagagtcgataggtgcaccacattcatcaatcagaatacgaacttgggttaccatagacgaacaggtccatcaaagtggaactcgcaagtgtagaacgagttcagggtctcgatgcggcgtccacgaactgcaacaatcttggacgtgtggatataggtgccatcctcgaagttggggttgccgtagacattaccctcaacccaatgcccgtcgccggctacgatgaacaccgcgcctttgatcacacccttgtcagtcttttcaatcacagtattcataggtcatcctgaaatgtagcatgctgataccttcccgttacggaaagcgtttctaaccaaatgctcacggtactcaatttgatcttgagccgccgcttcacgttcagccatatcaccatgatacacgattggacgttccagtttaggcggcaccttctccaatccatgtgatcggatgtgctcggttcctgctgcacgatattcgggaatcttgggaatgaactgtcttttcttttcaacgaacttcttaactggcttccttgtcggtacaaccttcttcttggctttcttccttgccttcgaagggagcgcagtgtgaactatcataacaaacttggtcaacgggaacatcaatataaatgagaaaatcttctacacaatcgaaatcgtctgctgacagagcgaattcatctggattacgcatttcatatgcgtgaatcttgtcaatgatttctggcttgaagttttcaacaacgcaacaaccacagccaggacgatatgtcttcttaccacgaaggttgaactgtctcatcgtctctcattatcaattagtgggaaggctggtggagatcgagtccacacctgggttcgccatctgcgcgcgtcgactcaccctttgacactgaaatcgggtatcagccgctctacctttgagctacagccttcataaaacgaatagtaccgagggaactgttccgcgaggagcgacctcatttggttactttaaatccctcttgcaagcagtgtctacaggggcctgacaaccaccgacgattcgaacgcctcctccacacctaacgcggcatggtgcacaccatgtgcttaccgacttgaacggctagtcttacttttgcatctggtgaggcctgcattaatcaatgttctgaagaatcatcacaaaggtcccggtacctgtccacagtgctttgattctgcatactaacatcataatgtccgggaagctatcccagcacagccccatatttggcagcctctaacggtatcgatccgttgtcttcgctttcagagagcgacattctaccattgaactaagaggcatcaaacttggcagcgagtgaaggtttcgatccttcttcttaggcttcaaaggcccctgtcttagccactagacgaactcgctatagaatttgtagctaagttaagggttcccgaaggcttctgagtcatcataccctagcaacatatgatgcaccgtaagctaattaagctaccaatctagtctcgccgcaacctttaacagtccggctctttgcaaggctccaactagaataccttgttgcgtactactttagcgcccttacgccgtttcgtcatcggtttggtggttccactagggattgaacctagaataagcgattatcggtcgctcgttataccagtttaactatggaaccaatttggttgcccgtgtcgggatcgaaccgacgacctatcgcttatcgggcgattgctctaaccactgagctaacaggcaataactttggggtgatcgacgagactcgaactcgcacgcctaaatcgtttggcatctggttcacagccagacttgtctaccattccaacacgaccaccactgaaactttggtacccagagagggactcgaaccctcaaaacctgccttctgaggacagtacgtataccaattccgtcacctgggcaaaactatcttacttctcaaccttggtgaagatgtgctttgcatcaactgcaaaatgaacatcatcaatttcggctgcttcgcgaatgttgattactaccgtatcaccgggctcaacgaatgtcacaagatcattcttggccacaacagtgaagatgttcttgtcaacagacccagagatgataattcctccctgactctttgcatcttcttccctacgctttacgatgacgaaggtattaaccggcttaaagctcattcacgttcctttgtttggtgcatcgtgttggtatcgaaccaacctctcgagctcttcaggcaagcgctaatccatctcagctaacgatgcaaattgtcttatatctgtatttactctgtgacaggatgaacccgttcactgaggtgcttctttgtacgttgggtcaactcgtcgaccacatcatacgatactttgtatcggttgaagtgtacaccaattacttcacctttgctcccaccatcaagacgaccagcgagaaccttatcaccgatttgaaaacgcgaaggcaacttcatactacaatctcctctcctgagtattcccttattttgcaccgagggacctgagtgacggtgttttggtatcggagacaggaatcgaacctgcgacgcgtaacttttcaagctaccgctctaccaactgagctactccgacatatttggtacccctggacggactcgaaccgtcaatgcctttcggcgctggcttctaaggccagtagctataccaattcgcctacaggggcatatcttcagcacataccaagttctttagcgcgatccgcagcataagaaccagcaaatgccacaggcttcaagtgaggatcaaccatggtcatcgccttgacgtaaccacgtgctgcttccattgcgatacttgaacctgccgtcttcttcgggttgatgtcgaggtgaatactaacctcgaagtcatagaagacatccttgaaacgatcatgaagctcagctaccttttcagcttccttcatcatccgagtgaacggctttgaaggatccctgtcgtagtcttcctcacgagttgtctcagcgaacaccttacaacccttgcaaccatcaatgtgaacaacgatgacgacggtataatccgcgtacatctttccattgacttttaccttctcggagtctgctccgagataaacttttgtctcagggctctgcgtctgcatgaacgcctcgactgctttcacgtcaattttcttctgcatgaccattacctgctgacaattataggatccgggcgatactgtctcggactagtatgtgagtactttaaattcgccctagcgcttaacgtccaagtgggtctcgaacccacgacctgccgccctaaatggcagccgctctaccaactgagctactgaacagcgattctttatcgcgaggtcaattcaaacttctcaactctcgcatattctttataccaccggtgtgccttactatctgcgttgtgcttgtctgcaacttcttgcgccaagctctcatctagagtagtacacagcactttcctttcttccgaccattgctcaggattcggatgacaatatgtttcggtgtactcataataagtttgatacacgtacatcacaacacctttttgatcaatgatcgcggattgttgaacctggatgtgccttcttaatctgtgtcaggaagtttctaaaatcctgaggagccttctgcctgccaagcgttgttggcttcacatgaccccatgactgagatgaagcacctgaatcccaaggagcatagttgtaggtcttatttccacaactcgggcactctgcgtctttgtaatctacgtcgaccttttcagtatcgccggtccagacatcaccgcggtgctcacattcgctacacttgaaattgtacttcggcatatctatctcatgttggtggacccggcaggattcgaacctgcgatgggctttcgccgtcggattaagagtccgctccgttcgaccaggctacgggaacgagtccattgttggtgggtccggtcgggatcgaaccgacttcctactgggtaagaaccagttgctctgccatttgagcttcggacccgttgattggtagcgcagggaggagtcgaacctccatctccgggttatgagcccagcatactgccgttatacgaccgcgcgtcaatttaggggcacttccgggaatctcaccctcagcgccatagttggtcgggataacggaattcgaatccgtctgactctccggattgacagtccggcgaccacacctagcagtccctatcccgatttgtttggcggtctatacgaggctcgaactcgttacgccggcgtgacaggccagcatcttaacccatagactaatagaccgtttgttttggaggactacttgagaatcgaactcaacaatctgcagttaacagctgcatgcctacaccagttggcctgtaatccatatttggctctggaccacggaatcgaaccgtgtcggatatttctatcgccgggttaacagcccggtgcctccccattaggcgcgtccagaataaatcagtgccagatatatttcgagtctgtgacacaagccttaccgcgatgtcgcgaagcatgtgccataggactatcatatcccagcttgtctagagttcggagcatgtcaaacatagcattcctaatctgagacttttcaactcttaattcaacaattggcttcttgtcagctgacctgatgttcctgcatccataaagcccattgcctagtcgtgtcactttcgtttccaaagtttccataacacttctctaattggtccgggttgcagggttcgaacctacgacctcaccgccccaaacggcgtgctctgccagactgagctaaacccggataaaacttttgtactactctacttatatggtacgcgaaaatggaatcgaaccactgacctccgggttatctacccggcgctctcgaatgttgaccgtaccgttattgtcggagctaggatctcgagctccaccttcgtatcgtcacagtcgtatcgccaatcctcgactcgctctgcgtgacagtatgcctaccgtctttgaacttatcgtcgccactgagctacccgcgtataaaacttggcagtcccatcgggagtcgaacccgattcttccgcttgagaggcgggagttctaaccaatcgtaaactatgggaccaaaaattgcatttcgcaaaaacttcaattgaagcgtttgaggaatacaactccttgaaacaaagtgtcgacctgagaatacagtctgacgagacgattcattcgtttggattatcagctcttgcggagcccttcccaacttttccacaacaaccatctttcgatgcatcattgttaaccgtcatggctgcctagtttaaagaggtggcgtttcctctgtcactgtaagttactctacctgcccgtttcccttgaccttgcgagccattcagaggggcttcctcttaggtgcacttcctgatagacaatcctcagccttgcgagccttaaattgcgttgattcactttcgtgtcaacgtttaagccactttcacttacagccgaaccagactttgcatttggtatagtctgcaggattcgaacctgcgtactttcgtttaagatacgaatgcttatccactaagctaagtctaacccactaaggacgagctggttcgtaagtccatacccttttggggtacagcttcttacccgcccttctctacttttcatccgctaggactacgattcgtagagctctcacgacccattacagaccgttgctgctgccaatcgcccttgcccgctaaggctcagactacgtgacctccgattctacattcatcgcgctcgtgtttgcatgtgacctaggctttgcgagcctgcaacccctcagcatacgccattggaattggcttcaatcaccactcacttcgattatcttccaggaatgactacctgaaatgttcgagcatgttgctacccaaactgcatctcggctatttctagtggaaccgtttccggcggggcgcttgtgggcgctttccccattaggcacatcactgtaccgtattcctaaaccgtcacctttcgatgactgagttgctagaccagacgtctcacgaggctaatgtttgtgcctctcgacgtttcgtgcctttgtttatcgtcccggcgactcttcagtggtctggaccttacttcatgttgcttattgtataccaagctgttttctacacaacctacagctggacacaatcaccttcaaacaaaagctcaccggtttccttgtctttgaccttcatccaaggcgaaccgcaacaaccacatccgcctagttcaacgtcaagacctttttccagaaacaactgcttgaggtcagtctcatccaacttgctcataatcatttcctttgtttggtagttcctgagggatttgaacccacgaccttcgccttgtaaaagcgttgctctaccgctgagctaaggaaccatataacttggtgtgcctggtaggattcgaacctactacgtcccttttgaggatccggggttacagcccggtgccgtcctccatcccgacagcagacacataaaattggtggatagggttggattcgaaccaacgatgcaattaagcggcagatttacagtctgctggcataaaccactcgcccacctatccatttgaaacttggcgcgcctggaaggactcgaaccctcagccatccgggtagaagccggatgctctatcctgttgagctacagacgcataattttggcactccacgagggtttcgatccctcttctacaccttgaaagggtgtcatcctagccactagacgagtggagcaaaacttggagcatctgacgggactcgaacccgcattcccgaacttgaaaggatcgttgcctattccaattagcagacagatgcgtttaatacttgttggcaagctcagcaaacatcctgcgctcgtccatttccttcttgaactcagcctcggcagctgccgcatggcgcgcctggatgatgctcttgatcgtttgttccttggtcatcttgttcctagcacattcgcgaacaacgtctgcgtctgagctataaacctggatgttaccgtacttcttatcacctgccagacctgtcgccttcatgtaatcgcgatggtcatcttcgtcatctgcaattgcgctaaagctacaacccatatcgacttcctcatgattaaaagcttggagcgggcaacgaggatcgaactcgtctctctagcttggaaggctagggcacaaccactataccatacccgcataaaacttggtgccccgtgagagactcgaactcccaacctgctgattacaaaacagctgctctgccaattgagccaacggggcataatttggtgggtcgggtgggattcgaacccacgatcgccggattaaaagtccgatgccttaaccgcttggccaccgacccaaattaacgaagaatccttttcgccactctcaggcgtccgactgtcggagacatcaaccttcgagaggtcttgtcgttacaagtaggaaacgatgtctttccttcttagccgaagaactcgcttcgggcttgtcggcgtgtcttttgatcgacttgcctgactgtgttcacagtctaaatgaagcaaacttctatgcaaccgtcaatgctgctctgattcggtcaatccaatctttgaagacatcgtcatcaggaacaacttcctgatcgtaaaacgactccatttcttcaacaagaacttccaactcttcgcgcatacaatcctcattgtttggtaccctgcaagggactcgaaccctcacgcctttcggcacatccacctcaaggatgcgtgtctaccaattccaccaacagggcatatctaaacttggtggagcttgtcgggatcgaaccgacgacatccagcttgcaaagctggcgctctcccatctgagctaaagccccaagttttggtggaccatatcggactcgaaccgatcagacagattccttgcaaaggattcccgggtgccctgcccatagcccaaaattctcgatcgagttaatgactccatctcgtcaagggattcactgatttctcagtttatcctccaccactcggtttaagtccgagaactatttggacccgttgacaggattcgaacctgcatcagcgcttttggcgccactccagttacctttgtagacgttcgtagcgtctggggatacaacgggataaaaacttggtctgcgtggttggattcgaaccaacgaccactcgcttccaaagcgagtactctaaccagactgagctacacacagataaaacttggagtctgaggcgagattcgaactcgcacctcatggctttgcaggccagcgcatttgccgttttgctacccagacataaaacttgcaggctctgcccctgcttgactcggcgatgctttgggcatccatacaatctgtaaccgaatcttctaaatttggcacgccgtgaaggactcgaaccctcaacacccagctttggaggctggtgttctgccaattgaactaacggcgtataacttgaatctttgtttttaaagaacgtcgcgtcagcctcgttgctgcgcgcctgttacttcatgttgcgtagtttacatcaaactgttttctacacaaccttttcttacatgtttcctgaaacggttcctaacttcatcagtaggtaactcgttgcccaaaacggctgcaacgtgccaaagcctaacagaaagtttgttaccgtcaagtacaagtttttcacataagctcctcggcgcgtcaatgtttaagtgctgaacccatatgctacatggacagcctttcttatcaaccttttcgcaccactaagtaaaaacccagaaacttttcagcttctgggtccagaaattcaaagttgaaaatcaatctttcaaccgtctccgtacccattgctaaaaccaaatccagccacatatcgttcgtcagcgggcttgacagctagagctgcaacctgatgccaatttttcgatgtgaggagaattgttttcatatgagtatttatgccgtttttctcagaatagccgagaagttaggaacaagtcctttaacttttctaccgctgcatcaaagtcggtgaacacctcgacacccttcgcctcacaagcgatacgagcattgtggaagtgcgagtattccggatcaatgtagacaacgactgcaccgttgctggaaattgcaatgcccagttccagcatcactgtaggcgactttgcatccgcaggaatgcagatgaagtggttgagcacgcgagtctgccaaccaaattcccaagcgatgtgcttgttcttctctgcgcgggtaggttcgaattcatcccaatcaggacgacaggtattgatcacgactgcatcggtatctgcaagagcagtttctactttcctctgccagtcacccttcgcagtgcttcctccaaggaagataggcatctgcttagagagtgtggtagggtaattgatgattttcatacttcacttgccagtttgattttgaatgcctcgattgctgcgtcgaggttactgtatagcttgatgccttgtctacggcagacaacttcaatgttgccgcggcgatagaagccttcttcgacacagatgaatagcttgtccggatcctgttcaccaccaacgatgtagccaaactccaaaagagaaataggagccttgctgtccttagagatgaacatgaaaacatggttggagtgctcgataaaatcaagctcccaatcaacctggcttcggaattgaggatcgctatccttctgctgccacgaactgtcccagtcatcacgacgaggattgtagatcgtgccagggaagtattctagttcacgttcaaggcgagtctgccattcaacagctgagcccatatcaatggacccagccaggaagacagttggtcgctgcggtagaccgcgaatacgaacaggtgccttgattacgtgcatcagcaggtgctcggttcccagtactggatttcgtcacctacatcccagtaaccaccgacgttccagtgaccttcccactcctgaccaaacttagagcccaggtcagtgatgatctcgatgatctcttcttcatcatccttgtcttcggggtccagcttgagtgcttctaccagacccagaatttcctgcatcttggcatctgccacacgctggagttcgtagtattccttatgcaggggcttgccggcttcaacagcggctttcacaagttcaagattgctcattgtcatttcctttgtttgaaagattagcaggtcgaaggctgccagtagccaccacgttcgccgaaactttcaaactgccagccggcggcgtgtccaatttcatgagccagttcataggcttcatcgagctgctcgtcagtgaatgaagaacgatcgacgttcctgacaagagcatcagcttccttgaacagctgatcgatcaaggccaggcgaccatagaggtccgtggcttgttcatggaaatcttcgaaagagagtttagtggtcattagcaagtactcggaacccagaagtggatgttgcccggctcgaaaccatcccactccagatcaaaatcataggtcaggtcagcaagacgatcgtttacctcttcgtgcagctcatcgcgctcatcttcatcttcgatgttgtccaggctgatctgatttgccagcttctggaacttgcggcgcagatcagcaagctcattgtacttagcacaataagcgctgtggatgggttcaatctgcttttcaaactgctcaaaggtaatgctcataacaactccgttggttgatgggttacagcgtcaatactgaatggtataggagtactcattctgtgtgcttagttcacggaacacaatcgaatcaattgatgcgagcttgatagtctcatcaaagttggaagtgagccagaacagaagtcgttccagaacaggctctgagccactcttgatgatcagcatcttgcgcatgttgagacctgaggaactattcgtgttcagccaatcagcttcgacgatgattgcctcaggcagccattcggcaagaatcttgttcacatacttcgtgtactcgacacagacactacagcgaggatcgaaatcctcaccgtgatgaatctcataggcgaaaccgatagtctcgccttcccttgtctttacggatgtctcgatcatgccagagttgctgcttcgatcttgatcaggtcatccagggtgtcagccttgtccttgtccagacggatcgaaatcatgcgcggcaggaacagagactgcgtatcgcgaccacgagatgtgatgcgctcgttgtatcgcacagtgatgatggtcggcaggtccgtcagcatgtcatcgcggatcgagtcagggaagtccttgaagatgccgacgtcgcaagccacctgaccgcattcggactgaaccttgagtgcgccaactcgcttctcgttcttggttcccttcttaccgtagtcaaagccgacgacacggaactccgcttcgatctcagccttgaactttgcctggaacttgactcgctttccttcccagagtgcatcatacttcttcaggatggtgccttccagtccagctcgacgagcttccttgaagtgagccagagcttcttcatacgaatggacgatgcgcgattcaatcgcttgcaccttgccttcgaaagactggaccttggcgaaacgctcgttgtagggcagagttttgtcttcaaggtcccatgcaaccagggtcaacatttctgcttcttccggactgatggttcccttgatggccttgttcacaaagccgttcgagtccttacgattcaaacgcttaccgtcacggaaacacaccagctcaccgtctaggctatcgccgggctgcaggtgctttgacgcccactcattgaaagaaccgtggtgagtaatttcgttgtctgctcggctggtcagggttgcagtctcgccatcccattccagacgacagcgagcgccgtcttccttggtctgactgatcgccgggaagccgatctcttcttcatcgtagtctgccgagcagagcatgaaggcaggctttgcgatcaggccaggccagcaacggttcgccgtttcacgagtgccaccgacacgcaggtcgcccagaatgactcgcttgagcacttcggcatcggacaggtacagtgaaaggaacagctcacctacgaattcttctgccttattgccggtgatcttacggttgcagattttagcctcaagctggtcgaaggcgtcatcgagagttacagctccaggagaacgagcccacagagcttcgtcggggatcttacgagtccagaagaggatcttcttgtcgtatgcgagcttgaacactcgcttgagcgtctcattggacgcgttgtccttgaggatcttgtctttggccagtcggctcgacgttgcagccagttgatcgagaatggaaaggatagtcattgtcatctcaaggaaagggaataggggccatccttggccatgcacatctcagagtgaaacttcgatctcagtcacgctgaaatcgcgatcacgaatgtatccgtcaccaacagcatcttcggcacgagcaacatcgtatccgccataggtacgaatgcgaagctgctcttcaccattgcggtgacggttgatcaggtttgctacttcattcagagcatcagccttgtctgtaaacagaacgcccttgccctttcgccagttccgaccagtgcggtatgcacctgcggtgttcggagtgtagaaacgattggtcggggtgtgcttgattgcataaagagtcgtcatgatatttcctcaacagagtccggaataggacaagactcatgctacaggtgatcacgtcctctctacatcattgtcagacactgtatcagaactcctggtcttgtgaagagactcgttaaagtttcgttgtcagcccgtcacgagctgtaaacgctaccttcatgtgcctgacccctaatagaatcagacacttacgtggtaccccttcctgaccagaactccaacagaatcagacacttacgtgaaaaactgaaaaatctgaacaagtctgacggtcatagggctgcggcgacactcagctttaacgcagcccttcacatgctagtattggccagcattggagggtcttggactgtcagtgcagggctacgaaagtcaccttgccctgaaccttgacgaaagcttctcggtcctcttcgccaacgacgagactgaactgctcttccgacagggcatcggacggacgttcttcttcgcgggcaaaactggacggctcgatccagcggttgccgccatcgatgctgattagggcgtacttgagccattcgttgttcagtgcatcgccctcgaccatggccaggatgtagtacccaccatgttcacccagtcgatagatgtcgcccacttggtgcggatagttgctgtaatcacgaatcatgccactgctccaattgttcggaattcaatctttttctgtaggaggcgagcgttgtcgatcgccactttcattgccggtgttacggagaagtctacatacacggctacgatgtccgcaaccttgagccaactcaactgggactggagtccaatgtctcgttcaatcggatccttttcgctcaagactgagtagtagaacagatgcgatgcgagcggggcttcgttcttgttcaacgagtccttggtcgctcgagcagcgtacctcttcatcttctctgccagtgccggatcttccgccatgaagggcgtgatgacgatgacattctttcgcggctgcttcgtcaccctcagattgttttctggcgttgccgcttggatgacggacttaggcgcagtcgaacccttcgccggctttgtctgacccgcgggatcgtcagatacctgacctcccgtttggtacagattggtcagaattttctttgccgtgttgtagggtaccttggccacgtgtcggtctcgattgagttgtcgagatatttaaccccggtgcagttgatgcttctcgatgttgtcgaggatccagtcaatgcagttcagccgaaccttcagagattcgccctgccacttgttgatggcatttccatcgacgtcttcgaacgggaaaggatcggtccagaaaacgtttcttttcttgatgccccgaacctcagcgttgaacatcgccgccaggctgaggaaggtctccccagcatcgcgccaatctccaccaatctggaagcctgcgttgaaacagataccggcttcgggtcgggtgacagttccgaagaaatccagttggtacttgaggtccagcagagcttccttgaccatcaggaagtggtagctcgtggacgagccgtccctggatcgcaggttgaagaacttcttccgacgacggggttcggtgacgtttttcttccaccaactacggatgctcacttgtccgccttcgggaagcttcccttgttgaatgagtggttcatggtctgctgctgaatgaccatttccatggcgtcgcgcatggccttgaggccaccgacaagaaaacgctcagtgacgtactcatgtgcccatgcaacgaactccgagtaagtcatttcgcgcgtcgacgtcttacaagaacaacggctcatcacgatctccgaccaatgaaaaagccctagagatttctccctagggccgttgtgccttaggcggcgtccaggaccagaacttcctcagccaaccggctgcccaccgagatcgggttgcccttcttgacgcacttgcccatccagccgaccagttcttcggtcgtgttcttgccgggctgcatcgcgtcgccgtagttcttgagcagagcgaccttcgacttggagtggtcgatgttgtggatggtcttgcccttgatctcgaagccgttcttcgaatccgagaccatccgggtcaggcgaccgtagcgggtgtcgaagaggaatgcgaccttcttgccgttcaggatgtggtcagcagccggcaccgggtcgttcttcggcagcgtcggggtcttgggacccttggcgacggcgaccttcttcggagtgcgcggggcgcgtgcctggcgaggggtcgaggtgtcttcgtcgccgtcgtcggagttgtcgttcacgacagtttcgacccgcttcttgacttccttcggtgccttttccggcatcttgccgccgttcatcagcttcatgacgtaggtgaaccactgcgtcatgtgcttcggatagatgtcgccgtcttccttgatcgcttccagttcgcgctgacaggtctcgatgaccgatgcagtcgaatgtttcggatcgaccaccagatcgggcttgacgaactccgtcgcttcggtggccttgtccagggcgtcgcagaagttacggtagttcacgttctcgttcgacatctttttcttcctcggcttaatttgtttcggttcggtgattggcatgctaagttcgttcacgaatttcgcaatcgaattcttctctgcctctggaatcttcagtccacggcttacaatacgcataagcgcaccgtaagtctggaacttccattccggctgtgcctgtacgcgctcaaggctttccggagcgaactttttcgcccacgtaatagcatatttcttgagagtttccggcgtcgaaattgccgaatagaagttgagtgctttgaccagttccagtttggtcggctcgacgtccaagtcccacgtcggctctctacctttacctgtcgcacgatctaacagctcgcgcctgatcgcgtctttctgtgtcttcatgttgtccccatgttggaaccccttcgatcagtccgactggtctttctgcacctgtcgctgaccacaatcgaatgttaatgaaggtagcgtgtaggcacaacctgaatcttccgtcaattcaacatgctaggcggctcaagggttctgaggccctcttcacgaggttctgacaagaaattgacccgttctcagtccaatctgaaccaaacggcgcagatgttaagaacgagtcaatttctgactctactagagtcagttttggacagttttggaagaatcagacacttacaaggtgctgacgaaacgccgccagatcaccaatcaggacatcatccttaaagacctgaggaacagcccgagccgaaggagccttcgagaagagatcctcgcgggtgtagtccttgtccagcttcaaaactttgaattcgatgcccttcgactctgcgagtgaggcagcggtgacacaattcggacaagcgtccttcgagtagatctcatacattggttctgattcctgtttcaagtaaaaattgtctgcacatctttgccacttgccttagcatggcgtcatccatcattcccatgtgacagtcatccgcagagagacctgtcattccttgcagccaagcatacgcgcgtgtgcgtgtcatgtagccagtcttccaaatgggatcgaagaaactgtgcgccttggactttagcttacgggaagcggcgttcgccagtcttcccataggcacctgagacgttccatgacaacctacccaagcctgacatttcaaacacgcccagaagtagagcgtgtagaggtcaggacggtgtgggtagatcgtttcgcccgtctcgagagttgcttccttattacagtacgggcaggtcgccatagtcaatagtgctcgtcagtgatccgatcacgtagtcggtggattccaattcctgcagagcagtctgcttcgtttcctgcttcacatgcttcaagaaccatggaataggatgcgacttaggagcctcaccacgatacttgatgttgacagcatccagacattcctttgcagtccagtctacgaagtgatggaggatcttcacgttgaggccaatgatcggaccttccttgaagagatacactgcccagttcttttcttcctggatgacctcttcatacatcgcatagacttcttccgccatttcatcgcggatcattgcgaagtcaggatcttccttgcatacctgattcaggatgtaggcggtccattctttgtgcagcaactcgtcctgcaagatcattccgatgatcgtgccgttgccgatgaagagcttgttctccatcattgcaaaggacgtggcgaaactcaccatgaagcgaattgcttccagagcgtaggatgcgtgcagagccatccagatcgcctttttgtgctcgatgacgtcaacattctcgccgcgcgccttacgaacgttcaattcatcaaggcgtccgtagtagcgaccaatgcttgctgccatatcaatgatctcctggttctggtgaacctgatcaaagatttcgcctgggttcgggtagacgcctcggatgatatggctgtagctattggaatgcaggttggtctcgaagaagccccagatagacagcagcgattccatctcaggaagagacacaaccggtccgaaaatctgcagaggtgctcgtccctgttcactgtccagagttgtctgacgaagcagattgctcgtaaaggcatgtcgacctgctggagatgcagccttcatgtcctgacggtccttggtgacgtcgatttcctcaggtacccagaagaatccgcgctggaccttctcatactgctgaatcttcggatacttcaccttgtcgaagcgctgcatggtaacggtaccatccaggaacatcttgcggtcaaggtaatttgtttctttgctgatatcaaactgactcattcaatctctccacgagctctcatttctgcctcacgggcgatgatctttttcatcgcctcttgaagcctatctctatcctcctgagtccaggggcgtgcgccacctggaataggacaaccaatgcttactttagaccagtcgatctcagagagtacatgctgggcagtcttctccatctgcaacgacctcctcgactactgtttctactttcacttcatccagaccatccttcgatccgcgcttgttcatcagactatagtacagagtctttccgccccagcgatggaagttcatgatgttcttagcaaccagtgttgccggaatcttgttaccttcgaagaacgccggattgtagaacgtgtcagtgctcagtgactggtcggtgaaagcctgattcacagctgccgtcatcaggtatccaacgcagtctcgctgattccacatgagaagtggttcatagcgatccttgagcttctcgtactctgggacaacctgtacgagcgagctacccttggattccttggtagagatcagtgccttaggcagagccataccattcgacgaatcaaccacaaccgacgagctttcaactggcgccgttgcctgcaggaggccattacggatgcccgaaactttaacacgctcacgcagagcatcgaagtccagagtcagctcaatcttgtgaacttcatccaggttaggagaacgcttgtcgataggcagaatgccttctgcatacgaagtgttcttccattccttacacggaccacgctcttcggctagttcaatcgaagcctcgatgcagtagtagtgaatgtgttccatccacttagcaaactcagcaagtgcttcaggctgaccataggtgtaaccacgttgcgcgtgccagtgtgcaaggtcggtaataccaatgcccagaggacggaagtcttcattcgcattcgcagcctgaggtgacaggaagatctgataggacagcaagttgtcgagactgcgaaccagagtacggcaggcgccacgcatatcctgaggcttcttgaacttgcccatcacgatcgaacccaaggtgcagagtgcgatgcgaccttcttcatcttccaaacgctggaacggacgagtaggcagcaagatttcctgacacaggttcgactgatagataggccaggtcttcgaatcaaccggaccttggttaatcacgttgtcaatgtagacttcgaagatacgaccagtgtctgagcgctcagtcaggaatgcaccgaaggcatctgctgcattgagctggcgcttgcgcagtccatcctgcttctcatacttttcgtagagtcgaacgaactcatcctgatcacggtagtatgcctcatacagatcaggcacttcattcggatcgaagaaggtcatcatctcctgattacggaaacgattccacaggtacttgcaggtcacaaccgaatagtcaaagtgacgaacacgattctcttccgtaccctggttgttcttcagaacgatcagttcctcaaactcgtagtgccaaatcgggtaggtgagtgtcgcagatgaattgcggatgccaccctgagagcagctacgcatatcactgaaccacttcttgatgaagagggtcaagcctgtatgagcaatctcgcctccgcggataggtgcaccggcggggcgaagacgtccgatttcaaggccgataccagctctcttagctgagtacttcgccaccatttcgccagtggcaaaaatgctgtcgagcgtgtcgtcgcttcggaggaggacacagcttgagaactgcttggtaggagtgccaagtcctgcgaggacaggggttgggagtgtaaattcgccattggaagcctgcttgtagtattcgttgatgcgcttcattctgtgcttggcaggctcagcgtgcattgccgtcgccgcagctacgatgtagcgaatctgaggagtctcaacgtattcctttgtggagcggttgcgaaccagatacttgtcaatcaactgctgaattgcagcatgggacaggcgttcatccttggtgtggtcaacaaacgtctcaatgaggttccactcatcttcagtgtaccactcaagaagttctgcagtgtagagacccttatcaacgttcttcttgatgatcgagtaaagagaaggaacttcgtattgtccgtagacttccttacggagagcatacgatgcaagacgacctgcgacatattggtagttggtgtgaccctcttcgctgaggatcaggttcacagctgcacggatagccagctcatcaatgtcagatgtcttgataccgtcaaagagttcaagatccattctcagttcaatcaacgactgagatacatttggaatcccatcacatgcgtattcgatctgacgctgaatctttgccacatcatacggctcacgcttgccgtttctcttagttacattttgttcttttcttcccatgccttacacctgacttcctcaatatgacggggtttttatttacccacaagctatagtggttataatacaggacacccactatgaacaatagagtatcaaggacttatacctgaccaaccaaggaaaagccctgaatgaacagggctcgtttcaactggtggctatgactggattcgaaccagtgtgaaacgccttatgaggacgtcggctaaaccgctcacccacatagccaggtttggtgctctcagacagagtcgaactgtcttatccgcgttacgagggcggcgtatcaccatcaatactttgagagcgtaattcttgaagttcccttttcaattcagccaggtggcggcgacccatgtcaagccaacgacccgaaccataacgttcaaggacaccttcgtagtgcactacttctgctgcctttgcagcgatcttttcttcgtttgtcatcttggtgcctcaggtcggactcgaaccgacaatgacacttcgttttgagcgaagccgatataccaattctctactgaggcgaattctgtgctagtcatgttccttcgataaacgtcgttgcagcgagatactagcggaactctctgcacccctgggcgcttatgaagtttggtaccctaggcgggactcgaacccagcatggctccgtcgagccggcggtttttaagaccgctgcgtataacctttccaccactagggcaaaacttggtgcgtcctacaggacttgaacctgtggccttctgcgtgtcgagcagatgatctaccaactgatctaaggacgctctattcttttatttaccgaagacttcttcaaggtcaacgccgacagcctttgccacttgcttgaggaaggcgatcttattctccgtctcacagtgaggttcgttgttgtccttgtcgtacttgatagcacgctccagaaggtccttcagcagttcaacttcccttttcaggagttcaaactcttgacggctgatcgtaccgaacggctgcgagacatcaatgcggcgttccttggaaggagccataggcattgagggaatcggcattgccggaatggtccaatcactcgggaggcgatctttccaacgttcctggaacgagtcaccaatcatcgaaacaacgcacataatcaaatcctcaaaggttactttttaggcttcttcttagccacatggtcagtacgaatcagaacactgtgatgatcgttctttccgccgcgctttgcgctaatctctggacggttagagatcatcaccgaggtcttacccttttgatacatctgtccaaacgcagatggagtgtgcttgtatcctgcacctaccaatgcgttatgcagctcagctgccttgtcagggtggaccgcagagtgttcattgatgtgatacttggtcacttcactttcgcgatgtgttccaggtgtctcatgtgcagacacaatgtccgaagactgatcgtgttctgcgtggttgccttcacggttctgagggatgttgatgtggtgatgcttcaggttagcctcagaaccacgaacatccacaagtttatcatctacggtcttcttcaccaccttaccggtcttgtcgcgccaaaggccatagccggctgcggacaaacccagtttgtgtgcttcctcagccgcagctgattctttcaggtaggtttcaaaactcattgattggcctttgaatttggttccaagatcgctctgatcttttctagtttcgcattacactccacaagagcatcgtgacggtcattggcgagccttacagcttcatcaaccgacacagtggtcttctgtggcacataacacggttccgtcaaatccaaaggaacgtgcttacatccagcgagaacaagtgctaacaacaggacgagaattctcatttgagacctcgcagtttacgctcctcagcagccttctttgctgcatcttggcgctgcttttcggtaatgcgcttctcaatgtcgcgcagcgttttatcgcgctcagacatcgtgtcaagtgccttagtcacctcagtcgcactctgattgagtgcaacgtcagcagccttcaccgttgttaccgacaaagattcgatcaactgatcctttgttgcaatcgtctgggtgtaggacgataccaacagatcacgttccttgatagccatcgactgtgtcgtaacacttccgatgattacacctaggaacaaaatgccgacccacatcatgatatcagacaaccatccgtagatgcgaggattaattctcttctttggttgttcgttgtctgtcattactgtgtgccttttcttcgtatttaatctctcgaagattgaaataggggccccaatgaggaactcagtaggggcgaggactgagcgattaggcgtagcgagctacggagtaatcggcgtcgttagcagcgacatttagctagtttgcatcttgatttacttgagttgatactctcaagagtggtctgctcttttctaattacctgcctgtcgaaacctgggcaggcccatcaacaacacacttgccgtggtgctcacgtcatcttactcttgcccacgcttcccatcttgtcagacaccgaaggacgatccgctctgactagagaaagcccgctaaggcgatcaaatgtgttcttggtggacctggcgggaatcgaacccgcgtccagacaacctttcgattggcttcataccactataacttgccagctctttcgagccttaaaccttaccagtctccagaagcgccaccgcctccggaatctccgccaccaccggaccaatccgacgatgaaccgtaatctgtactgcctgacgagaacgaatcaaccaaaattgcagcagttgcccagccgaaagtatcatcactcgagctacggctgtaactgtcctgacggctgctactgtgacgcgtatccctgtgagtgttcaatgcggttgcagtgtaaaacgtctgactgcacaacggacatctgtatgccatattcttcacctcggggcaccactgcccacaaatcatagtttatagaaccactgtgaaagaacaagcctcagtcttcttccgattcttcgatcagcatttccttagcgaaaatactcatttcgacccaatcatgcggatcggttacatcgaacccagcctcacgagcaaggtcgaagaaatacgtgtctcggtaggtcattttaccacttgccttcggggcaggttgcgttaacgagtttggtctttgcaggcatgaagcaaccgcaagaaccacatgtgagaacgacagaattgaacagcgggcacgccttacaaatttcgtacctgcgattggattcaccaccgttcgagaactgaccgttgatgacgtccttcaacccgtccgtaaaagtatacgacataggtcacccaaataaaacaattgctgaaacaagatcttcatcttgattgtactcagacgccaagatgatttcgtttcgttgtgcgcgggtgatatcaaaatcatcaaacagatagaggtgctgagaaagactttcgcctcgctcatatgctccatctagaacgaaaatgatatactcgcggtctcggggctcaagtgcccgtttctcgtctgtattcatcgagccaaactcccacctgtccgcaatctgggttacggtagactgtggtgactttcatgccaccacagggtccacagaactgagactgctgagtcatcaagattgcctccttattcgcgataaggtaatcgacaatctgttctcttaggcgctcaattctcgccatgcgtccaccacacgatgttcatactggcgacccagcttgacgagctgtgcttcatcgaagccgtaaatctgcgcggtgccccaatacttcggagtcgatgcacgaacgcccatgctaaacaggtcaccggtcttgacgacttcgatgatcacttcgccgttggtagaacaacgtggtgcgccatacttggacttacgaacccagacaatgctgtctgattccatagggacagtagtttcaagctcgaaaccttcctttttaagccactgcagatacgcaggatcttctggcagaggcagaacactcactttctcttcggtactcatttcaattccatgttgaggggttacttcccagtatttactctaccgaagatttcaatgttgcaaatcgcttgaggaagacacgcgccgtttgttcttgggtcaggttcatttcatagaatccttcccaacgacggtggttctcatattccgcaggccagtcgcgcttggagtgttccttgagcgcatcgcgttccgacaggagcagcattctatccgcgaacttgacagtctcatgcagcttgaaaggaacgccaaacttttcagcgattactgcccacaggttatcttccagttccgcataggcaggaatcattcgcttgaacggagttggaatgtcgcacaggtaagcctcagtcgcatcatgcaacagtgcttgcagggcatgttccggcggtacagcgtaggagacgtggatggagtgctcagctacagagtagaagcgatccacatgaccggcgaaacgacacaccttagacagagcatgagcaatgtcctcgatgagaatggattccggatcagggtcaggcatgtagagattgacaccagaccaggtttcgatgaagtcacgttgcatatgatattcctttggtttacctaaaaggacaaaggcaccgaagtgccaatgtcccaccctttcactcttttagcacgactgactcgatgcgaaccattcgccatccttcagagacccacccataccatatgcaggaccatcgaaattgaatgacggctttgcctgccaggaacgcgttgcgccttcatcaaagaggccatcggacagttcccgagcttcctcgagaagaccctcagcctcaccaatcagctgctcaatgcgcttcttacggctttcaaaatcagcgtattccatttctcattcctcagcaagaatggctagatgcctgccattcaccagactcgatccagccacccataccataggtaggaccagaccagtgataggtgtcgttgcctgccagggcgcgtgcctcttcaagctgctgtgcagcgctttccaggagtgcaacaatcttctcgtgacgctctttctcgactgccattacaaaacttccttctgatagagttgccaaccaaaccacattgcgctcacttcttctcgcacgtagttaccattttcgtcccgcttgcagaactcatccttaaacaggatgcctggcttgatccgaagatcacttccgacattcttgatgaaatactgccggaagacagcttcctcaaacttctctcgagttgcgctcttgatgatttcatccaggcgcgccgcccagacctcaccaagctctgcaacctctccaccccaccacttcttagagcggatggccttcgctagttcagatagggccttcattcctcttcctcttccctgtcacgcagggcttctagttcacggattgcttcctcgatgttcaccttgaagcgatgtgctgtatgaccaccaccccaaggctttcttccagaaagacgatgaccggtgccatcttcatcagagacatacagtgatgctccagaagcacccattacaacttcaaaccaggcgtccttcatatcagcaccaactcgcattccagtcgctggactcttcggcaccgagaatgtaattgccatcctcatcttggacttgcaggtcgatcttataatcgacgttgtgcttcacattgagttctctcagctccttatccagttcgttgacaaggagcttgatgagttctactcgttcttcgagattgtctttagccattagcagttactcgcgttccaggagggaggatcatacgggacaggctcgtcatcccagcacgaactgtgcgaccagtgctcagagccagctggagcaatggtacggatctcgtcgatcacgaaatcgcctgggtaagcatcacgacctgaaacgtcgatacgaccgatcagctttgcttcatccatcagagccttgatctcttcgaccttctggatgatagatgcctttgcagcttcagtaagcattttcttccttcacgtagggcttcacattgccgctttcgacttcacgccagaagcggtccacatattcctgattatacaggtcattcacttcgtcaaaattatcccaggcaaacttccggaaccaaccagacgtgatgctcgtgcagaccttttccagcgcggtgtcgaaagccttcttccgctgctcgatagtcttcaggttgaacggaacaatggcgcgctcgagactcagcacatagctttcctcgaggactgccaacagctgcacctcacgtggctgagcgaagaactcttccttcgaagttccgacttcctcaccgtcaggctggaagaagcgataggcaggctggtgcagatgcttcactgcgacatggatgctgtcgtgatcgtagacatagcgaatgccatcgtccttgaagaagtcagccttggtcacaccaccttccagcttggggtgcttatagtcgtaggtccacttcttgcgatccttgagccactcgctcagacacttcggaaccttgtagccgaggctcttgagcatctgaatgtctcgcatcgttttcaggaagtgacgcgagtttttcttgtacttgtgcgacagcttgagtgccagcacaaccgacggagaaacagcgtagtagccttcctcggtcatcttgtagaggccgttgttcaggacgatgtcaatgagggtatcactgacagaatccagccatgcgatttcgatatcgaagatggcgtcgtttccattacgagggaacatgaacagatgattcgcatcttcgctgtgctgaatcttgacgaagcgcgtcttgttctggtcgatcatcgccttgatggaatccatcgtagcaatgaagtccatgtccaggttcctgcgctcaacagcgatgccgtgtgcgcgaagtgcgttggatccaatcagcagagcagtcatcagatgtctcgattcttgaaacggttggggaggtggcgttcttcggtcaaggtgcgcccgagatacagcaggtcagtctcaggatcgtatccgacaatgagacgatgctgtccttgggaatcaaatacccaggtgttgatctctcggcatccttcagcccaccaacggaaacatgcaggtcggttccagacaccagcacgcctgatggtggtcttgaattcttcactcgccttgtagagctcaccgtgctggttgatacggtagagaggcttcgcgtgacgactgaatcgagcagccattacagaattcctatgcgagtgatgacgaggtagctggagtagtcgccgggatcgtatgcgtcgtagcccaggcaatccgtgtggatgtactgcgcctcgatgtcgaatttctcgatatcatcactgccgaagtgttcacggatcttctccatgagctccttcagagtgaccgacgaaaaagtcgtgtcgatgtacagcacatctttcgtattgtcaggctggaaagttctgatgtttccaccgaaatcgttcggacgtgttccgtaacccatgactaactcctaatcaccttagtccatacagtctacagacagtacctggataggtcaaacagaaacaatcggctctagaaattcccagatttcgttctcgtcgtaatctttcgttccaagattgaggatcggaatgcctttgtccaaagcgatagaaagagctgtagctgtaccaccagaaagttttccttccggagtccatgcaatgacgaaagaaacgggagtgacgagatcagcaccaaggacctgatgacagtttcgtgcgtgtgctgaacgagcccatgccttgcagttcttccaatgaccaacatatcgttcggctacgatgtaagcatccttcgatgctccaacgaactcagatgtacgaccattgaatcccttctcaggcagccagatttccttacgaccattgactgcatcgcatcccttctcaaatgctgagtctgctccggcagctccaccagatacaaggatcgcatcgtactctttcgataggtaagatgccaacacagacattagagaacagatcataggaggcgtttgacgagatcctatacctgcatatcgaaattgattcataaaaattgtttttaaaagaattgcggtttattggagccacactttggctattaccaccaaaagtgcgacgatgagaaaagggaactgcgtccataccatcaccactcaaacttgcaatctgcttcccagcaggacgaggtgaacggtatcgccctataattgcactttggtccctcgcgggattcacgccatagacaagaattcagttagtaatcaacttgcctaacacctgttgccgtgtggcagagcaggtcatactttagaacctctcggttccttattctcacgttacgcacttccgacgattgctcgccctgcccactctatctcacgtcgcgactacgcttagccgacggctagttgggcaacctgttgttcatcatataatttgcgtcactggattagtcgtgacgatatagctttcactttactggcttgcccatgtctcgagcattattcttataggctcgatatgagttttccgattcgatgtattcctgggcacgcctgtcagctgattccttggtatagcattcgatcgacccgatgttgtatccctgcttctttacccagtcaccatcagaatctaggaactcatagccaccgaaaaggccaacaaacattgaccagcgtcggacaccaaacctaccgtttttgaattggacaattttcatgcaaggattgtaattgataatttcattcgtcaaaatgaatgctggatatcagatatgaaacatccgattctgcagcaagattttagctgcctctttgagatctttggtttcatgcaaggctttcttgcattccatcatgccataggatgtgtcgaaggtctcaagcatgaatctcttgagaccttcgatttcttccttggttggtttagcagacacgtctcacctttgattcattatcagtatgaacgatctcgcagtgatcgaagagaggcttgtagtctccactcgacaagctacgaacatcgcgcgcttttgccagggcagcaagagtctgccattccggcgtcacatatttgagcatcgaagagttaggcttggtgttgtaattcttacgattacagatcacctcgacccacttgttctcagcatcatccaacatctttaccagcttggtgttgtcccagagagtcatctcattgagacggttagccacctcagccatgttctttttggtgaacagagttgcgccatatccttcccagaacttcgcccagcggctgtctgcaatcatggtaggaccgttgaacagaccttccagtgccaggtagccgtacgattcgttctgtgaggaaacaaaagtgaacttcgcagatgcgatgaagtcttccttttccttaccttgaaggttctgacggatctcgtagttggtgactccagcttccttgaaagccttgtgccatgcgtcgggagctttgatgccaccacacatgacctttcccttgatgccagtctgcttgcacatctcgacaaagagctcaggtcgtttgccagtctcgtatttgccgatgaacagtgcgccttccttgtgcatcaagccaagatggctcggaagctcgtcaggcagcagtgggatgatatgatcgaccttgacaccatgcttttcctgcagccactcagcattcagaggtgtctgagtcacagtggtgacaaagccagacttcggaatcacttcgttagcgaagtagatcacagcatcatcgaaaggaaccttgctcaggctttcagacatcaagccgtggtgagtggtgtagatgacattgaatggctcgatcatcgcaccaaaggaaatgcaagccaatgctgactcagggcaggttgtcacgatcgcatcatagagtttctcttccgtgaacactgacttgttcaaggcatgacggaattcttcgatctgatcgaagttgatcatgatgcgctggaagatgcctggctcctctgccttgatcttgaccatctgaggatagccataggtcacgacattcggatgatcaatctcataaacctcgagattatctggtccgacgcaatgaatctctacgagtgtgtcgtcaggcatcgactttgcaatgcctcgcacaaacgtagagactccaccaccccgtttcggattcaacatgcgcttggtgacgagcaccattacgcgcttccggtattcaatccctgaagaaaacaggttggtcagtgacattagttgtacctcggatcaaaagaatctgcacgctcatttgcagccgatactgcccagctgagatcaacagcacgtgctctcagtctttcaatctcattccttgcctcacgcagcagatggagtgtatcatagtccacctcaccgcgcagataagctaaaatcttatcttcgatcctctcttccatcgtcaagctccagttccacagaaatagacgcaccttcaagatcagctggactgtagccgttgccatagcattcgtcagactcacgaacagagaagctgacccgaccaatcttgagattgtgcttgttgttatttttcaggtgctcaaggatgatgctttcaatctcagccttggacagtctgatttcgctcttgagaatcatttatctcaccttagtaattatgaaggaagctgcccttaaagagcagcattcctacgaacagtatccatgttcacatagtcgaagaaggtatcacgaccgtagtggctatagacaacatagtccttacggtaccaatcgctcgaaggcttgttgaaagcgaacgaatccagcgaaccttcggtgatggtcttccactctccagtttccggattgtgatagacactcaggtcacctgccttcgacttcttgccagggtcagtgaccggatccttgatgatgtctaccttttcgccgttgatgtatgccaggcatgccttcatggcaaacttgaacgtatcacggttcaccttctgcagaagtccgccacccatgccgaatgcgatgttcgaggcactgattccgagattcttgaggtattcaagaatggcctgcacgtcttcgatgtcaatgccgtcaccttggatgacacggacatgatccggaagaaccttgaagcccttctcgttgacagtgtagccgaccttttccatcagtgcctggatgaccttgactggcatatgaaccgggtcaccactgtcaggacggagcacgatagtcgccccagcttctttgacttgttcgatcagggtcaggttggtttcgggatcgatacgggttgcccacatgtcaattgcggcgaaggtatcgtagctgtcgatcacacaggcgaaaatcgcgcccggctttgcatagctcttcaccatgttcttgtaggcgttatactcgccatcgcgaccccagctggtcatcgtcgaatgttccgacgctgagatgctgtaaccgcagacatccgcaccatagtattccattgcagcttcaatacctgcgacggtgtcggtgcccatgaagttgatcaggtgcgcgaaggcgccaacatgtgctgcgccaggagttgcaccacggtatccgaaatcgtgcagcttgaacggaagttccgcatcagcattatccgacgtcaggtccaggtactgcttgatgaccttcttgatctcgcggctcttggttgccacagtcgaggcataccagacatagctcagcaggagcgtctcgatatacgaggtcacccacggcagacgctcgtcggtgttgatcacggaaatcatcagctcgttgagcggcacaggagtgccttcttccaccgagcgaatctcgacaggcaggtagccgttgtggtcgttgacgatcaggtcccaaccttcgcggttgaaaggaacgccgtgcttggcacagaatgcctcagcctgatcaacgtgattcttggtcacgcgcttgttgagatattcatggatgaagatttgcagaccagcacaaaccactgcggtaacgccaggaatcttgctgccacgcgccgtgacataactcttgacgagagtggtgcccttcggatactgcatgaagtgcgagaacttgtagctgtctgttgcaaggatcggattgaaaatcatagaaaactcctttctacgttggtgtgattatagtctaacagtgtgcctcagaaagacacaccgttgtcagcgagaagcttgcgagccttttccagctcggcttctttcgctcgttgtttctggttttctacagcagcgatatcggcacggtatgcctgacgaattacttccttcttctcttcctcagaagcatctgtcaggaagataggatgcaactcgatagagtcagccgagtcaccgtcgctccattcacagagatcgtagaaacttccgtcgaaggtgtagtaagaatgctgacggttcgcattggttgcgaacttatcacgcggcttgtgataccacttctccagttctttgaactccggctcgcagtgaacagaccatgcaagccgatgctggagatcaaacaacggcgtcaggattgcagcagccttgctgcgctgttcttctgcctgtcgctggagtcggtctgcttcttcgaagaagccgtcgataatgtccttcatgatatttcctcagacgccactcagggcgcggtcaatgatctttccgtggtcggagaagatctcacggtagttgatttcgcccaacggaacccagcgtgcttcggctgcgtcatcgccgcccttgaccttggccagtggcttcccgtcagcaagcttgatgacgtggacgtgcgtaatgattctgccacggtcttcttcgctgacaccgccggcacgatcatgaacgaaagtgcggacaatgcagcggcgaagcacatcatcctgcagatggattttcgtttcttccttcagctcacgcagagcgccatcttcgatggattcgatctgatccaggaatccgccgggcaaagcccacagacccttaccaggacgatcaccgcgcttgatcagaagaatatggccactctggataaccacgcagtcagtggtgacgaacatcggcgggaacggcgaacctgcccacgccttgcgataagcctgtatggcgccatactccgcgaaaaactcttcatagatagctgggttgtttttgatgtgattgaccaggtaggtcagagtcgacggatgcaggagacccgttgcgtaatgcagcgtgttcgtccagaccatcttgcgaatgtcggtggcgttgtacttgcggagcagtccgctttccagttcttcgaagccggtgtcgatgtgcttccactgcgggaacatcttgagatagaagctcgacgcatccttttcgtgaccgatcaggacaacggctttgtccttgacctgaggtgctgccatggtgacgagagaatgaatctgtccagcccattccgtattcgaaggcatgtcgtatgctgcatcgaaaattacccgttcacgctggtaggtgcccagcgaatccagaatcatctgcatccgctcgtcgaacgtccagggattcttgaggccacgaggaccaccggtgtcaccgatcaggatgagaaccttcttggcgatcttgaggccttcctcaatcgcatggaggtgacccagatggaaaggctggaaacgcccgatgaaaactgcgagatcatgctgcataagaaaactcctttcttttgctgattataacgatgtatggtttcgtatcaaccgaaaaggcgccggagcgcctcgtcggatacttctacttattaccgcagcttgacgccctggtcaacgccggtctcgaacttctgtgccgtgtcagcgccgaccacaaccttgtacttcgacagatcgaccttcggatagcctgccagcttcatccagaagcccttccagacatagcccaggttcgtctgataggcgcgcttctcatccagcagttccgtctgggagaccttgaactcgttacgaccagcttccatcgtctgctggagtcggttgtagagttccgggttcagattcggattctgttcctgcagccactggaaggtcttctgctcgccggcaccacgactcacgccttcactgccatagcgaccttcgaacgttgccttcagaacttccttcaggtcatcgcgtgcgatttccggaacctgtgccatttcaccgatcttgatcgtgtactggcccagcacgttctgattgtcctgccacttcgcttccaggcgctgctcggcttcgttgccgtagttggctgcgctgacatagctgcctacagcgaagactgcgcccagtgccaggatgcccaggaagaccagcactgcaatccacgccgagcccttgttgctacgaatgttcattatcaattacctttgttgggtttgtgtgattttagattaacgacgaaaaccatttcggatgtagcgaatgttcgggtgcctgtcgtagaactcctcgttgaacacgtcgtacttgtgaagaaggaaagttgtcaccatcaagaggaccaggacaatgcctaccagccaagccacttgctttgccgtcggaccaccctcagccttcaggtattcatagtccttcatgttcttacgatggaagtcggatgcgatcacctttgtgattacagccacacctgccttcgcattttcagtggtaccgtacttctggagctcgtcgcgcatcttgacggcgagcattccgttacctgaggtcttgccaaacgtgaaggcttcgacccagtcgatcttggttcctgtgacgcctaccacaatcaccacatcattcttcttgccgccgagccaagcacgttccagcgtgtccttgtactcccgaccctgttttcctacgaagaccaacacgacattcacttgtcgcgctgcacccatagttttcaggacttcgtcgagctctgcatcccaggcctttctgttcgcaacacctgcctgaatatcaatggtgtggtcaacgcgatagtagtcgtagatgcgtgggtactgagggatgatcgcagccttggactttgcctcggtttccgccagcttgacgttgaacaagctgctcggagctgccttgacatagttggtgtaggtgtgcgtgaccgcagcatgttcaccgatctgtaccgcagtccagcggggaggttcgcggctgccacgacggtcaacacgatcaatctcgaggttgcctaccgttgtgaagacgtcccaatcccagtcgttggaatgctcatagcatgtgctgcaatgtcgggtgcaggatcgacttgaacctgtgccactacacgtcgtgtagcagttacacgaatacgaatgcgagcagcttacccaggtctgcttcttgcctgtcacctgcccgttgaggatttcgtgatcggcggtattgctgtatgccatgcagccgtagatcagaagaaccacgagtgcgataccaccgccctggagcagaccttctttccaggtgatcgtccttttgaacgcgaaatgtgctattgcagcccacgtgatcgggatcaagcagagccagagcgcgatttccatctgaacctcagttcggtttatgttctacaaataatacaggaaatatctttctttacaggaagactgggttgaacttctggccctggtatttgtgcagatttttctttcgcaacctttctacgccttcgaaatgtgcttccatgaagggcgaaacttccatgtccaggtctttcagacggtggtgcgtgtagaaagaaagttcgtcataggtgacgccgaagttttcttcatcactggtaccgttgaccaagtcacctgtcggaacgcgggcagcaacacgctcaggtacgcccaacagccttgcccactcgattacttcgaacttgtgtaggttcgagatcggctggatatcgaccatcatatccgagttcttcccgaaccagcctacgtagcccatctcatccaggttggttgtgccgatggtcacgccgccgagtgcttgcgcgtaggcgaagaagctcaggtaacgcatagcgtagctggtgttggcgaagacgtcatcgtcgctcttttcgaggtcaagagcaaccatcatctcgctgaaagccagagtcagatctttcttgtgccacttcacgtttcggaaacgagttgtagccagctgcaagagctcgatatagtcctgttcaaagacattgctgtaggtgtcgaaatcgatcgtcacagcatggacttcgacttccggaatatgagccaggaggaagagaaccactgctgaatcaacgccacctgagacgcctaccacaaccttcttgatgttccagttcaagaagtagttcttcagggtaagaatcttctgatacggatccttccttcggaacatgtgcttgaacatccgaaccgacatttccagttcgttcgggtttgctgggatgaaatccatgacttatgccggagtgaagatcaggtcgccgcgcacgatgaagcgctggctatccttatcggtgaaggggagcacggtgtggcagagagtgtgcgggaagagaacgatcttgccagccttcggcttgatgcgaaccgtgatctcgtcattggtagcctgacggtcccaatcgcccttggtcaggttcggatcgttgtcgatgaaagcgatctcgccagtttcgcagtcgttgaagtacattaccagcgaatacttcgtggcgtagcgaatcgacttgcccagggaccgagcgtgatcgtagacaacgaaatcgctgtcatagtgagggaaatgttcgccgccctgatcgtatcgcatgaaacggaaatacttcgagacgcattcgaactcccacagatcaccatcggcatgaatcaactgcggatgttccagagtctggatcacttccgtcagcaggtcggcgaagtcaccatcccatgcacagaaacgatgcgaaccaatgccactgtcgatattttcgaggccagtgacagataccggatacaccgcgcctgcctcattgaagttttcgaaggcattctccacctccgggagaaggttgaggctggtgtcgatttcgatcacgccgttcttgtagatccgagcttcgagctcaaacggttcgtctcgagcgatgccaagacccaggattgtctggacgttgggcgagatgatttcactgatggacatggctgagcttttccttgaattcgttgaagtggtcgtggaaggcggtatcgaatgcctgcatgctacagcggctggagatatccgtgaagggatatgcccactctttctttcggaagtcgctgatatccaggagctcccaggcgccgtgccagtccttgagattgatcaagccatgcagctttccgcccatagcctctacccaagcctgcgtggtgccggtgaagatgtccgagtcaagcagaaccacatccttcggaaggaaccaattgctcacagttccgttctcgagagggttcttgaagtagcggctgatcttgacatacggcaagaagccagcgtattccttgcagttggtgtgggttgccccaatcatctttgctgttcgcttggcagacttgatttcatcttccaagaaatacggacgcagagagacatactggtccttgaagtattcggagaacagatcgaactctgcctgattcacacagcgcaggatgagatgcttcttcatccgctgcttgttctcgagcttggaggtgttcagtccagtggtgtcctcaaaccactcgacgatgaccttgtcggtgtagttgttgaggttctggaagtcagcacgatccttgccacagaggatgaccggaggcttggccatgtcgtagatgccagcgcgcttgcccgcagccaggaaggcatccagttggtcagtgaagttctgatcgcatcggttgttgagcatcggatcaatgtcgatcgaggcagtgataccgtgctggctaaggacacgcttgatggtgtcgtagcgatgcttgttcgatgcgagctccgaccatgcgccatacttctgggaagcgtagtccgaattgctcggtgcgatgacgagccatgcgcctggatacttccgcagagcacgcttgatcactgagatgtgaccatcatggaacgtgccgaagctacccgggtagtagatgatctgatcgtatgcgctgatcgcagctcgcgcccagggctgcgagaagatctgattgaagggttccttcggttcgaagtagccgcactctgctgccacctcaggggtgaggtccctgtaaattgctgactccatgactaactcctagtcttgggttgatattatctgattgtcttgccttcgaagagcttgtcgatcttcgcgccgttgacacattcaacgtggtagaccgtcctgtactgctcgaggaacgaaaccttgcctgctgagtatttgttcgcgggtgtaacccatccacgaacaaacccgccatttacagtgcacatagcaaccatctcggcttctgcaccagggatgatttctgattcttggatgatctcgccgcacccagagagtgcgacggtcatcagtgcggctgcgaggagggtcttgatcttcataccactagtctacagatgtggtacgaaagaacaatctttctattttcagcggaatctcgagacagaaactacgtcgagtcgaagctcgttcaagctctcgaaataaccttcccagggaacgctcgtagaaacttctgtcccatcttcgcgaatgtaggtacggctataaccagttccttcctcgagagcctttcgtgcagcctgagctcgctcgatagtttcgaagaggtcgatgaactcgacgtagtttctgtcgtgtccaaagctatcgccagtgttgtaatccgcccaaagcagaatgtaggacttgttgatgtctacatcgaagggaacggtgaggtcacggtaacgcgcctcaggaacgatttcgatgccgttgacggaaatatctgccgcagtgtcatcacggtcccaacgatcctctggatcaccggcgcgcgtgacgtaacgatactcgtcgtaatcgactcggatgtgagttgccatgattagatcctatcttgaatttctgacaaaaggaagggcgatagactcgcccgtgtcctttagaacgtgattgctggtttgatgcgcttgattcggacgtcttccgatgcgccggtcttgagcagttcattcactcggttgagtgcctgggtcaacccagaaaactgctcgttgttcacttcccacttcaaggtcttggtgtatttgcgctttgtctttgtctgttctgtcataacgaatgtccacaggaatgtgtttaccacattcgttattttaaagacttggttggcatctacaaatgaactacgatactagatcccatcttcgatgaagtgcatcttcatgcccgaattgcggaagatgattctttctcgagcgttgatgtgttcacgcttgcctacgtagatggaacctcggctgacagaagaacgaaatgcagtgccagggatttccagcaagaaggcatctgccagttcgcacatggagtggtaggtcttcatgtctcgggaattggccaggtggatgtagttggcatgcccgaaatggaaagccaggagggttgccctcgcgagcgtgtgcatgcctggactacaggtcatcaatccccagggtcgatagtagacccaatcgctcctgtcaagcggttctgctccaaggtcgtgcggcattgacaagccacagtcaaccatcttgtaccactgttcatcagtcggtccggtgctcacagatatcccctgtagatttcttccataccgccgccagtgatcttgaagtagactttctgttccttcatttgatggaaccagtccgagttctcgatcttctcgatgacctgcctcagggcggcgaactgtgtcttaccgccaccgctgacagtgaaatactcgaagcccttttcagttggaatttccatgcaagcttctgcatggaagctctgccgactgaacgaatagacgttgaagtgcagagggagaatcaggaaagcatcttcaggctgaggccaagactttttctgacgacgacgtcgcttgagcgcgtactccagctgtttccccttgtctgcaccgcgtggttgagccagaacacgactacgaacacggtacgtcttttcttccgtcatttctgcattccttggttggtctaacccacactcacatattagtttctttctgtatgcaggacaaccttaggaatcagacacttacgtatctgtttggaaccaagaatcagacacttactggcctatcacacaagaacccctatttctaggggtctcgtgcccaaccaccacaaggagttcttgttacaggaaacggtcgtaccagcggctcttttcgtaccgctcgaatggtcgaatgacgaacatatcgaggagtagagcgaacacgctgcctacaagccctacagccaggagaattgcgagaatagccatgatcaactccgcttgaagttttcagattttaacaggcgacgtgcttcctgtatagcctttcgacgacgcgtttcccacatgccataggcaggaccgaaatcacagttctcagcatcaaactctagcgcctcaacgagttcatcaatgaggcgcagggttttgtactcagtcgttgtcgaagccgaagacttttccataggtctgctcgaaagcgtccttttcttgaacttcggtctcgaaggtctgacgatgataggtacggctcatctgtcggatcagcttcttcggaatgtcgatctcttccgccaggttgtcgatgtgagccttgatggtcgagcgcgatgcttcgatcatggtcatcacattgctaatgtcctgacagacacccttcaccttggccaggatcttcggatcgttcagaacggggtactcgacagcattattagcagcattggtcacaggcgttacctttctttttggtgaaaaaattgattagcatttcccaagccgtaggctccttatcgaactctacgcatgggactagtctacacagctgatctcggaaactgtcagccttttcatctagtaccgaaacctcaaaccgaatgaggtcagtaccttcttcgatgttccactgcgaagcatgggtcaccatgatcccgtagaaggcaccgaagtgtgtacggttgaccgtaccgttgaaaatcttaaacatggttgcgcctgttctctatgttgtcgagtctaattgcctgggcaagccagagcaatgcttggtgggtacgccaattccgacctccaccgatataggtacgacaacgcagcgaaggcatgaactcaggttgaaactctggatactcttcccagtcttgcatcatcaaatgcacatcgccatcaccggcggtgtaaaccttcaaccaattcgcgccactgcgacccttgtcgtcacagtcgagttgatagatctgttcctgctcaagaccatctggccacttggcagcaaacggctcatcaagataatcccgacgagcatgttctatctcaagcgcgatttgtttggttgggttcatcagatgattctcagaatcgtagcgatatcgacttcggaatggacaatggaagcaatgtctcgcacgctgtacccttggtcagcatacttgtcgacgatcggtttgatcgcctcaaagacttcctcagaaagggcaagtgcctcagtcgtgtatcgctcgttttcgggattgaagaggtgcttaaccattaggtagttcttcccattctgtttccgggatacggaagacatggtgtttggagaaatggaatcggaagatgacattaccacctgcacgactcaactcgtatgccatgcaattacgaagatgcttctttgacttcgcagaagcctgccaatcattcttatccatcagcgaaatgccttttcatgttttcaaggaaggcgcgaatgttctctgcgcctacaggattctgagaatgaatgctgtaggtgaagtgctttgcgtcccacggttgatcgtagaatcgttctgccagatactcagcgcatttcttaccgttgtagtaatcatcgccgagatcatgatcaaaggcaacgtgcctcggaatgcccagctcttcgattatctctacgaactcccagtagttgcgagccacctcagcattttcaagagacccagctgggtcacgctcgtcatcgaggaacagatcgtaattagcgagcgccacaggaagcctccgacaaaagagacttgccggcagacgtccttgcgctgatcacagtcatctcaccacggcgaacgccacccgacggcttcaatatgtcgaggtaatcgaggacacggataccgcccttaaggtccggttcccaacggggcggagccttggcagtgatgatggtcacatccatctttccagcgaagtcgcgaagttgcttgtagatatcttgagtcactgtctaaccttcatcttgttccattcaggatacaggcttttcagttcgtcctgttctttttgcagggaatcttttataggattcttgatgccagaggcgagttctgcaatagtgatatgcgtgagctcactttctaatttctgaatcctcagccttgcctgagacagggtcatgctcgtttcagatagtctgcatggacgagaccgtcaactttgacgtcgctatcaatggcctcaagctggatgtgcgtaccttcaacgatacgcacaaccttgaacttgatgcccttgtacttgtcgaagtgcggcgcgagggtatcgaagacgtaactacggaagtagacttccatacccatcccgatcaccggcggcggaccttgtggccatcatacaggaaggtatcgtcgacgatggcgtcagcgatcttgttcagctcttcgagagtgatcagctcactccccgaacgaccgctgatcgcattggtacacatgctggtcagaccgctcttctcgaggcgataacgtgccgaggtgcatgcctgattgacggtgtacttcttgacagtgcgttcgctgtgggtgtaggacaagctcacttcggtgttcctttagttgatgtgttcacagtttaaacgatgacaaagaaagaacaatcttagatggcgaacgggaaaggactcaaagtttcgcggagagtcagcaggtcgccagaaagttcttcgataggatggctgtagtaagccgtcggaactacgacgcctacagcagttgcacagtttcgcatcgcaccttcacggaatagagcgaacggcatttgcagacctttcgcgggcggtgcaatcttttcgtacagctcttcgatactttcgtcaccgccgaaagtgcgcagcagcatgatggtcttgtggttgcgagcccagtcagaaagattcgacaggtaggcacgattccacttcgggttcaagaacttttcgtacagctcggggatgacgtgcatcccctgaatgcctgcctggacactcatgctatagcggtttacaatcagatacagtctcattttaatccttccagggcggaccatcgtccggtgcgccgcctgcagcaagattgaagatctcaaccatgcgataggcgtccattgcagcgtcatgcagtgcgtcgtgcttcaagaagtttcttgggaagccacctgctggttcgtactgtccgttttctgagccagtcagaacgtcaatcatcgtgcgcgtgtcacgaatcttccaggtgttgaatccgcacttcactccagcctgaagatacatgtgttcgatcttcgggaagtcaaagtatgtacctctcgaccagacaaatgaatctttccagcgataccccgaacgcttgatccagtcgttgagcattgtcagaccagaagccatgtcaacgtcttcttccgacggcttgaggatcttctgtgctgcaggttcctgagtcttccaccaatcaatggtgctctggtcagtggtgcgcttgtaattgacaatctgttccttgacactgaacttcacatggaagccatcacggatcagcttgtcgtagtcattcttcacacctggcaccagctggaatgctgctacaccgatggacagaacaaccgtgttttcgcgcataccgagggtttcggtatcaatggatagatgaaatggtgcgtcgctcatgcaggtctctcataggatgtgcgtatagtataatagctgaacccttccgagcccagctattattggtagtagatcagttcatcagatcgaagaacaacttggcttcatctggcttgttgaacaaccacttagccgtgtcgtcaatcgagatcatcactggctcaatgtctagcgaatgttcgatagaaacgatcgtaccgccgtcccacgatggttctgtgtagacgtttcgctttgtcttgaactcgctgacttcgcaagtttccgtcatcgacttgggcaacgaatcacccatgaaccagaacttcgatgttgcctttgtttccacagttttctccatcatgaattcttcaaacgagctgcctaccgattcgttcaacttggtgttgtgctttgctgccattgccttcaccacgttgaggcttacaagctcaatgtagtatgccttgtagatgcgaagttggttttcaggatcaaacactgcccattccggagaacggatcgagtctcgacccagaccagcagaacgataatccttaggattcttacccagttcggcttccatctcgaagatgtaaccacgggtgccatagctacgcgtgatgccaccacccttgtcaccaacgtactgctgtgccttgtcgatgacattggagaagtagataccgttaccaagcatacgaccaacagctgaggagtcgtttgcagggatgatctggaatccgttacgcagaaccatcgaagcagcaatcgtgcctgttccgtggaacacaggatcaagcgtaccatcctgaggatttttctttcggaaggcagcaattctttcagccgagcctgggaatgcaacgttgaacgacttgagcaccttgaatgcaacttcgccgtgcttgttgttgcggtacttgttcaaacgaatggtctcgagttcaagcgcagtctcatcctgtttcacttcggagaccttgaggtccacaagtgccttgccgatcgaagccttagccgccttgtcgatatcgccgatggtctggacgatgtttcggttagacgtgactcgaatagccaggttgttgtacttcaagatcgtacgaatacgagcatggtcaagcgggaagtcaggcttgataggatgcttgtagaggtcgtccttgattgcctcgacgtaagccatctcgccctgcatctttacgatcagagtacgagtggttcgcggcaggtcagcaaagattttgtctgcaaggtccttgtctgcgtcatagacgtcgagcagaacatcagcaaagttcttgttaagcgagtcacgatgcgacttgtcgcggatggtatgaacaccgttgacttccattgcaggagcaaatttacgaacaagctccttcttggcatcaatcgtaatgtcatccgaatctgcgacctgcatcaactgagccgcccaacctgtggtcgaattaatcaggttttccttgattgcatctagtccttgtcccttgaggcaattgatgtagagttccgaatactcggaagtgtccatcatgccacgaagcgaagctgtcgcgtgcgggctattctcagcacccttctttttctgggaaatccatgccttccagagttctggattgtaagcctggaacagcttgatagtgctatcgctgtagttctgtttgattgtagaaaccaaccacttagacacggtttcgagagcttcatcatagtgaggatcactcggctcgacgaaccaagcagttcctagaacacctacagtacgtgaatctgctgtctcccaaggcctacggtcaggctcatccttcatgatctttgctcttgcccaacgagcagccttcaccgcatcttcgacattaccgtgcaccgaaattgcgtgaacaaacgaagccagagcgtctcggctgatataaggcataacaacaggatcaaacttgtgatctaccaatgacgcgaaagtcgtgccgccatgaccaatctctccagaacgcttgaagacttcttccttgagttcagggaattgagcaatgatggtcttgaagagtgagctatccttgccgtaatagatcaaccatggaacaacatgacgtgccgctgtggtgtgtcctttttcaagcagatacttgaaatagttaggagcctgtgggaaaggatactcgccatactggttaggtgtcccagtcattggccagttcaaaggttcagccgctgccatcttctcatacagccaaggcatgatagctgatgctgtagtgcgggagtttgcattcatgtagaatgccgcctgctggaaagccttgaagataaggaacaggtcttcctggctcttgatcaccggtgtgatatcaaacttgccagccatcgcttcgcctagcactgaaacaaagtgatcagacatcgcataggatgcgccctgagtgaccttcttggctactgtaagaagatcaaggatctccatcgcatcaccttcgaatttcttcagagcgatatcgacgtcaccgatcttgttcacagcatcgacaagcttcttgacctttgcggaagccttgttatcgaaggactccttgtcaactgcaaggttcctaccaatggtgcgaccagttctgatatccagacgagcaaatgaagcctcgacgtttcgtaggatgccgtccagagtagacataggcatcatcaggcactgaatcagattacgaatcatctctgtttccgcagaagcacttagccacaggtgcttgcctgcatcatagatgataggctggagacctgcactggtaatctgtgtcaagtgatcaagaatgaaatctacaccgtcactatcgaacagatacgacacagcagttgtcactggatcattgccaaagctgccaccgaaggcattctgcttcaaagtcgaagcattgttgtaatcgatcagaagattgaatacagcatcggcatcctttctctgacccgacttcaacagggtgttgtagataggaccgttgatctgagatggcatcacaccgttagcaagaagcatacgcgcaaaggtgctctgcgtgtattcgttctgttcaattcgaccatgagacttcttaagctcatcaacctcgaatgtcttgagggcgcccagaaccttaggcaggttcgccttgatgatgttcgactcttctcccttaggccaatgatacttcatcatcagagaatggagcttaggatcaaaaccgttgaggtacatctcagagatggactcgttggtcacaatcggttcttgacgattcgcaacgacagtctgaattacagcagcaggcgttggagccttaggtgcagtattcgatacctgagttgctacagcaattgcgccagcctgacgatccttatcattgaggatcttgagcacagctgccgaagccgacggatccttcttacgaatccactggacaaacggatgctgctcccaaggcacatgatagccatgagacagaacaaattctggagatgcgacagccttcttgaaacgatcaacgtcaaagtgacccttgaagccgaaacgttcaaggtagctgtgaataccaccctttagcttgaacacatggagaagagcagccatgtattccgaatcggaaccgtgtgctgcaccctgaggtggcaacgaaccacgctgcccctttgctggcggcttggacatagcagccgcaacaggcgcaggagtcgttgcagttccagatgcccactggtgtttcaggaatgcggaagaatatccacccagagtaatctgttcacggaattccttagccacagtcgcaagctctggacgtgctgacagcttccaaagcttgacggttgtcgtttccagctgatcctttgcatcaacaaagtcttgaacagcttgatagacacgaggcgatggcttgttggtgattacacggcaagccttgatgatatcgcgaattggatcgtccttgatgtcagcagaacgaatctttccgctcttgacaagtgcaaggaacttcgttgccatgttggcagcgaccatgttgatgatacctgcatcatgtgccagcttgatagcaaggctccaatcagcattggtgtcagtcatattggatagctgtagcttacccagtgacttgatgtaggtcatcagagttgcagcatccttgatcttaaggagaccagcaaacccaaggaaattgatatagaaaatatcggctacgcgttgcttatccgtcagcaacgtagcgagaccagattggtccgtgtaaaagctgttctcttgtaggatcatattcttgtcagctaaaaataaaggacgacatgtgccgtcctttatttaatcaaacgttggtttcgagattagttatcgaaaccttccaggagtgccgcgtactgcgacaggtcatccgtttcacttgccggtgccgaaggctcctgacgagttgccggacgtgccggttctgcgaactcacgttccacagcctgtgcctggctcgttgcctgcgatgcaggacgtccacccggtgcgttacccagaaccgcctgtagacgggtcttgagctgatcgtacgacttgaacttctctggagcaacttctgcctgcaggctgtactgcttgttccacagagcttccagagctgcatcgtcgccaccgaacagcggtgccggtgccgcaaagcccgacttatcgtacgagcgctgcttgttggagccgttgtatgccttcaggttgaagtcagcaccatcccagaagtcgaacggattgaacggcttctcgtcctcgaacttcggctgcagagcagcttcgatcatttcgaagatcttcgaaccgtatgcaaacaggaagaccttgccttcgttctgcgggttcttcgaatccttgatgaccagaatgttcgagatgtacttcaggttacgcttctgcttacgagcgagttccttgttcgcctcaatgcccgagttccacagttcggaattgacttccatgaccgggtcggcttcgttgatggtcgaacggcagttctcgatgtaccacttgccggtcttgtcgttcttgaatgcgtgagaatacatcttcacgaatggatattcctcacccactggtgcggtcaggaatcggatcacggcgtaaccattaccagcttcatcggtcgtgagcttccaatagcgctcatctggaccattaccaccgccgcccttcttctcgtcagcaagcttcttgctgaggtcggcgaaattaccacgctgcttcttaagtgctgcaaatgacatctttagtctccgttttctctatttgaatgaggtcttactgtctcttatggacttactttgcctctacaagtctgttgagttgttgcttcaggaaatccccatccacttcaatccaactactgtatttactcaacatgaatttccgttcttcccagagagggtccaacgtgtcctgtgagcaatacttgaacgccctttctaacagcgcgagcgtttcatcggtcacaccaccaataatgtccgactggtgtgatacaatatacggactttgaccgtccgacaaaaggagtttacgaacatctatcttattctcctccatgaacatcacaagacgctcaatgtcggttcggacaacgtacttcaaagaattgattacagccattcgcttcttgtgatactcgacattctcttcctcgagaatctctccaatccaagaatcacgcttacgcttgaacattgagatcagcatttgaatgatcttctctcgatcatgctgttctgcgagctgcatgaagtaatacgcgtcctttctctttagaagttgctcctcacgaagtgagagcaccatgtgacgcttccaaattagatcaccgttgaagtgtagcttgagacctacataatcttggaatgttctaagtggtgcgcttagaaaagtgttctggacggtttctgaatgcatcgtctgattttacgttcacgtgctgcgtcttctttcagacgctggatgatgacaggatctaacgtactaacaaactcgtcttgctctaagtcgtgttcctcacagtaatctgaggcggcctcgaacaatccaatgttgtctctttttgaccgaagcatcaactcttcaaggatcttttcactgtagctcatttaggtgcttctcattgtgcaatgtttgcatagtaattcttgactcgacccaagaccatcggaacaaacggcttgatgtctcgtaccacgatctgcgggaatggcgaatcgcgtcgagcaatgaacaatgccatctgcttgatcttaaggccaagcatatcatacagcatcatcgagtaggcagtacactggaggtagtagtcctcgaggtattcctctcgcttctccttcttggagttcttgcagtcaatgagagtcagcacattgtcgtacagacccagacagtccaaataacccatcatcttcatgtggtcagaccagaccttcatctggaccgcaattggctgcgtacgcttcaagtagggcttcaactgtccatacagtctatagcctacatcattctcataaagggattcttcaaacggtacctcattgatgaccgactcaagcgaatcattgaagatcttatcgagtgaggaaccaattgccttagactcagcgacgatacggtccgcttcttcatgtccaacacgctcacgccaagcatcaaggccagtcatatctttggtgccactgaggacacgcgtcacacccggatatctatcgagtggtttgttaccatccgccttgaactcttggacgagtttacgtagttggattagatcagtcatagagtgaatcaccaattgttgagaaaccccaagtcacatcggggtcagggacctttttaatctttcctgtgatgagctttacttcctcaggagactcctttggtttttcatcgccatacaaagattcaagcatatcagcataatcttcaatactggccatgaactgaatgcgctcttgcatttctgctaaattgttctcgcgtttatagaaccccttggttgcttctataaacttttcaaggtgctgatttgctcgtggcgaagggccacccatcaaacttgccacagacttagccatgattaatgatctttgatagtactacctggatgtgctttcttaacctgagacaagaagtcgcggaattccgccggagccttgtgtcgtccaagcgcctccggcgtaatagccgcccaagtcgtagcggtgaaggtctttacagacactccaccacattctttgcatacggcttcttcgcctgactccatccgagcaatagacatgatctcagtttgaacatggtcacacgtcttacatttgaagtcgtacattggcatcttagaagccgccttccttaaggatcttggtgagtttcattgtcgtcaggtacccaaacatcttacccgtcgccggagtcgcagcctcataggcttcaacaattttagtggttaggtcggcaggaatacaccgaaggtcgatcaacttcctatttcggtggaagcgatcaagtgctgccgaatcaggacagaagtactctggattgttgatgccgtgcttcttccactctgcgagcttgtctttacgaagtggcttctggcgcttcttcggctcagccaggaaggtatcgtcatcactcagaatgttcggtacaccatcacctgcgtcaccctgacagatatgctcaaacagatcatactcagcattcttcggagtgaggaacttcttatgccaaggcgaccactgcttgattgcagaattctgatgctgcaactggatcatatcgccgtcggacgtcaccagacagaccggagtgtgaggagcataacgaggaccaagtacgcccatcaaatcgtcagcctcagcaccgtcaacctccagacacttcacagggaagtaatcacgaagctcttgcttgaactgatcgtacattgggaagaacgaagtccaatcgaatgtggacttgtcacgaccttccttgcgcttacccttgtagtaagggaagatgtccttacgccaataatggcgagagtcgaaagccagaacaatctccggtccgaaatccttacctagttttgctttatgcgacctcatcttgtcgatacacagattgcgtacgacgtgcatgtcgacctgttcattggtcttagcatggaagtcgagaacctggctaaagaccagattgctcatatcaattacgatcatgattaatccattcgttgattacgtttgcgatgaatctcacgagagtctagttcatactcgtcccaatcttcatccacatcatgcgcccgccggaggagatctttcgacctcctctcggcacggcgatctttactagaagcgaagtggtcggagtgaaactcgtcacgacggttcttgctgctcatatgttacgacttccgcttagccttgcgcttggcaatacgagcacgtccacggagggcgcgagcagtattgtgcttactcttacgagcgattgcctgacgaaccagatcacgatacagtgcctgagcatacaggtttgctgcactcgtagtgccttcggacagatcggtatcggacagcgaggtcattacatcatcagtgataatcatttcatttctcaggttgggttgttcttgattgcgtcatcttcggctgcgatgatccatgccttgaccaaaccgcttcttacgatgtcttcgatgccaaactcatggcgaatgaagaactttccgcaagcacctgcgattcgaacaaacctatggaatccactcttaccaggagtcaaatcggtctgacgagtgtcaccacagaagatgattctggagtcattacctagacgcgttactactgtatcaagttctgcgaatgaggcgttctgaaactcatctacaatgatacaggttttgtcatatgtcacacccctttcaaaggaagtagatccaaaactaacggcgcccttcagcttgagacattcgtaggcatcagcacgcttcaagatcttgttgaagtttgacttgatggctctttcgtagacttcgagtttctgtgcttcggtaccaggtaggtgaccaatttctcgcgaagaaactgcggagcggatgatgtgaatgtgtcggacctctcctgccatcatggcttggagtgctagggcgagcgcaagatacgtcttacctgtgcctgcataaccggtcaggacaagattctttcctgcttcccagtcaaggcgtgcttcggcttgggtacctgatccctttgcttcgaggttgaagttgtcgaagagtggatcatgctgcgatgtctttggcgacttgtgaggtttacgtgccattattttctcttgagtggacgtctaactttcgtgagctcgagcttggcattgagcccagagaaagtccgtttctcaagatatttctgtaggtctggaatacttgttccatgttgtacctgggcgttgatgtctttagcaacgaactgcggatcgaacatgatgaccttaatgccttgattgaccgctttgaggaattgcccatacacctctggatttgtctgatagtctttgtcgaagatcaagacaaggtcttttttagcatgttctcgcaggtatttaatttcagacatgatacttgcgcctgcgactgcgatacagttctcaacaaacatcgcatcgaacggtccttcgcagacgtagaccttcttgctccagtctaccctgtcaaggccccacagcttctttgcagatggatcaatctggagcgtgatatacctgatcgaaacgtcaccaaagaaacgagcctgcatgtagaccagttctttcgcctcattgtagaacggaatgaggatacaatcactcttgggaagctgtctctccttatagtcgtctagttgattcgtaatctgagtgatgtcttcgcaatagtagagatcattccagaacttctccggaatcaatcgtcccttgatgtattcttttgccttgtgatcatttggaagctctgcgatgctgagacagccatgaagcaatgtcttgtctgcaaacttcggctttgagatgaacttctcaaaaggatcagtctcgaatgccttgactcccttgaatttctcaaaggtgtactctttcgccaataccggagctacctctttcaggaacgaatacaaccccatcgacgcgccacagttgtgacacttgaaattcgcattgccttcgatctgatagaaatagccgcgcgtcttcgactccgacttctgcgagtcaccacagaacggacaacgaaaacgagacaaggttgcacttacctctttccacccaggtaaataacttgacacgagcctcgtgtatttcaaatctagatagttcatgtgatctattttaatgcggtgccgtgcattcgtccaattaaaggtgaaacaagatggtagatagaactaaagaagtcgtgaagggtgcagttgctactcacctcggttgggtcaatccgaagactggcgagctcgtcgtgtctattcgtggactgcccgacgcagtggtttggtcaaagcgcacgcattctctggaagatttgcaagatatgatcgcgccggcaggaattcgtgaactgagcgaagatgagattgccgctatcaaggaagatgcatttggtgaagaattctcggaacgtaaagtctttagcgtagacgtgggtgaccttactacagaagaagctacgaaggtagtcgagaaggttattgaagacgtcaaggctgctgaggttcctgccaaggcaacaaagaagaccacgaagaagaccaccaataagaaggctgccgagtaaggttcccagatgagtgatgtgaaagacttggcgaaagaaatcgccttagacggttatggtaaaggcgtcttccatgccaagacattcgacaaagactttgctgtcttcatgaccacaaggaagatgatcgaccggtttctaaagaccggtcagatcaatgaaaaacttctgatcaacaatatggttgtgactttgaatgtcttcggaccaaagaaggtgacagctatttgtcgtgtgttgctgaatgatgttcaattcagtgtcgcaaaagctatactcatgttcttgcatcaatatgattggtcgattggcgccgacgtctggccaaatcgaattgttgtcgatatcctaaaggacgtcactaatcgttacaatctgggacacctctaatgctaagtaaactcgcattgaacacccagacattcctttggggcatcggcatcgcacttgtactaggtattggtggcggcgccggctcaatttggtatgtcaagggtctgcaaattgatgccattcaagctacgcacaaagccgaggttgccgaaatggcgaccaaagtggctacggctgaaggcgcatccgccaatctcaaattgacatttgaaaccagtctcaaggacaaaaagaatgaactcgaccaagcctacgttgcgcgcactgcttctctcgatgctgctgtgtctaagcttgctggtatccgcctgcgcgacccatcagcaagtggtaattccggatccaccagtggtcaaggaagcaccagcggcagtaacggatccaacgccaacacaggagaactactttctccacaaactagccaatttctttggagtttcgcaggagagtctcaactctatcttgaccgactcaaccaatgcaaagcctggaacgccgaattgacgtcccagtctcagaagtactatgatgagattcaagagctcaagaagaagctcaagaagtcctaatctgcgatagcacgtaggagcgcaccggagaatccggattgcgtacaatgacaggagttgccgaagccgttgttcttggagcagcggcttccttttgcccgttttgaacgacctgggtcggcgcgctgattacaacaggagcggttcgggctgcctgattctgcttcgcagcttcgcgtaccattggtgtaggcgaagtcgaggatgccatcagattgcctgacttctgagccgcttcaaggaatccaagtgagctatgacctgcatggttgaagcctgcagcattatacatgcctgcgccaccagatgttttctgggaagcccattgcgatgcgatatagtcttggaacttagcagctgagattcgaccagacttgaacttgtcaaggttgccaccctgattgagcagcgtcagtgcaagcttatcctgattctcagtattgaacagatcatcttccttgaagcctgccgcagccatctgcgccttgagtgtgccactaatgaactggtagcgtcccactgccgaactacgacggtttgcaggaataccgcggctcttctgttcattgagcgtatcacgctgccactgcatcacttcgccgaatgtcatctgagatacaggcttggttggcttgacacgagaaccactccataccgaatcgtatccttccttacccgcctcacctgctgcaatctgattgagaagatcgcgctcaaagtttcctgttggaccaacagtgacacgaccacctgccattgtctgaccggaagttacagaagtgccttcacccatcgtgcgaccagctgtcacaggaccaatgctacccggagcagagtcatatggacttgcactctggattggctcatacttggtgcctgttggaacaccctgcggattataaggtccgcgagtctgaagagttgatgcaccaacctcagcaggaacgatatagatgcccttggagcgatcgctcatcaagtcgagcatcttcgccatagtgacctgcatagagtcagtcgctgcagcggttttgcgttgcgctaccactggagcagctgcaattgcagccgtatgcaccggaggcttaggcgcagtagctggcttggctgctgcggttacagcaggtgtcgagctaccgtcattcttaaggtcacgtgcaaggatggcagcgtcaagtccaagacttgctgctgtaccaatgcccggaatagttcctgcaagaccagatgctgcttcgaggcctgcacctgtccagtcaccagcgtatgctcggtttgctgccaaaccaagaccggcgattgcaccaatgataggaatcttcttgagtagagacttgcctgccgtctttgctacacccttaccgatcgctcctgctgctgatccagcaatctttgctccgcctgcgccagcagctgctgcaccagccttagccaagattccctttggagcaacctcagctgcctgcacagcgctacgtgcaatgaaacgaccagtcttaggatctcgaagagcatggcgccctacgcctacagctgctctagccgcagttccttctgccgcaataccagcacgagcaaccgttgtcgcagcttcacctgccttacccatacctgtgatagaacccatgaggcgaccaacacctggaattctagatgcaaatctaccaacaacgccgcctagcttggcagcaggtccagtgataagggatggcaatagagcaggaaggcttgtgatggtcttgagcagcttgtccatcattccgccgccaccttcgccaccgccgatgccgttcttagcaagagcctcgacagcatcacgaacgcgtacggtgtcctttgcaatgacctttagaaggcttgcattctcttcctgtacaccgagtgattccttctcagctttgtcttgacgttcctgattgcgagcagcatcatcgcgagccttgtcacgattcttcgaagagctcgaggtagactcgccgcgctctttctttttcttgtcgccggtggatggaaccttgctgagatagctaccaatcttgtccagcgccggtactttggaagcaccagaacttcttgcgagtccttgaactagcttgttgcctgctaccttattgagtctcgaagcaacgatgaggcggttgccagcagcaccaaccgcctcagaacgcatcaatgaagaaccaattgttcttagaagtgctgggagcattttaccttaacctgtttgattcaacttattcttttgtgtttgaactgcaatcaaagaggtcatttcgatctcaaacaacggcatatcgtccagttcatccagacgatagccatgttccgttactagtaggtgcctcagttcaagcatgtctactagcttgttagttggatagattacaggaaaaaatcgtcgagcccttggagctcgaaaccatccttcctgccgcacttagggcaggtcacgtccacgttaagagcgaggacaggaacgccttcgaagaatgcggtgatctcatcaagtgccgaagtcggaagttcgttgagccacttcgtcatttcgtcgaagttgaaatcggagccagggacagacatgtcttcgccgtccaagatgtactcaattcctgagaagatatactgatcggagattccaatcacatccttgtccaggtcgagtttcttgaagctggcaaagtcaggcatcttcagcttgatagacatctgatcgtcgatctggattagctttgaagattcatatccttctggatatttaatctgggcattctcgagattgaggatcagttcatgcttggagccacaaggaacagtctttgtgacgatttccttcttgccttcctcgacttcaacttcctcttctacttcaattgtgccaccacagctgtactcagcctttgagcgagcaccggacgacttgatgaaggagtgtaggaagatgtagtcgataagatgcataggcgtcttagcaagatcaagctcgccaaacgtgatgccatcaatgatgtctacgatagtgttgatgatcgcagctgcatctttcagttcaaggacagttagcaggttcttctgctcaccgacctttaaggcgcgatacgagatcgtctttttgagctctggaatctccagagaaaatctaattgctttgggtgttcgaagcgccattcacatcactcgttaattgtctttgtttcaacataggatttgcccttgaggaacttcaacaggtcatcgcaatccatgccaatgactctcgattgaatcttcttcccgaactttgctgccgccaaccaacgatgatgaccatctacgacatagccgtcggcacttgtaattataggcttcgcttcccatttagcactggagatcaggtagtctaccttctcctcattgaagttgctttgcgtaggcttcaacttccatggactgagagattgaacgtccgtgctaatgtcgttgtctttcaggtctgccatgaacgcatcaaattgcgtgagctgcggcataccatgacgcattttccctttgccatccttggcgttgggaacctttagatcttcgtacaaccatgtatcgaaatcaatcatcgaccttttgtcctgtcttttcatcgacggagtgggaagacttccacttcatcggacctggctttggatacagagtagtgatgtaccacttcttttcattcgggtcccacttgaaacccttagcctttgcctcatccttttcggagaatggaacagagtagtaatgcttgtaggtcttgcggtttgccgcagctgttctacgagcctcttcccactgtcgcttcttttcacgttcgtctgcaacgtgatttcgataggcctgtttttgcttggattgcatctcacgctgagttacaaagccgccacctgccgctgcttccttcgcacgcttgtcagactcagcacgatgcgttacagcagctgctctatgcttttctgcttcttcggcgttgccttcgtactcgtgatgcttgaccatggtatcatggtactttgccatctccgagtggtgacgagtgtaatcagcgccatgcttagctgccatagcatccttttgatgccattcggcttgcttgttgtactgaggatgcttctctaccacaacgatcttggcacggttagacatgtaggtcttttccttgccatcctcgtatttgatagtgactttccaatgggttccaggctgaccatcttggcttgtcgtgctgacaaccgcagtaattcgacctggcttaccgtttagctttaccttgtcgcccaagccaaattgcttaggcgccttcgcttccagcagagattctaccagcttcttaccagcctgtgagacagccgcattgatttcctttgcgaactctccttctcccttccgcttctgtggcttctcgggtggcatgacgttgtctggattcgccacacctgcagttacgttggcgccttcgctcatcttaggcttccggtggcttaggcagagtgtcgcccttgtcgtcgccaggcgcagccttgtccgacttctcaatcacttccggagtggtcgagcctttgtccgaaacaacaggcttcaagtcacagccttcgccgtcgccattcttcttttgatgattcgcatccgagattgcctttgcatcttctgccaggaagtcttcgaacgacggaatagttactgtcaagtcaaccattttctaacctctttttcattgttgagtactgatcccagattgctctagggacattggccttaaaggcttttctatcgccagaccggatggcctcacgaacaacggaagcagatgtcacacgctccgtttcaacgaacctgacaagacacggctcatcaagctctttgttggcgcgttccatctgcgccttgtactgaccaatgcgatcggaaccgcagtagacagcatcaggacaatcaccaagcatcttgataatgtccgggagatacccagtctctgactggaacaccctaacacctggcttcaccgtctctagaagtttcttttgataggcgaagtcgaaagggttcttctccgtgtccttcgatgacacctttcctttgacgatgacaacaacagggttgttcatcctctcaagaacagcaaggtgtccattgtgaaccggctggaaccttccgaagaacaagtcaaaattagccacccatcactcccttgaaatagatcaaatcgcggaagtagtctgtgacaattttgtactcagtcttatttacggtgacaacaacgccttcgaaattcttacccatcttgtgctgctcttctgcctgcttcaagacatagtaacagaactgatctttgagtgttgcaatcagggccttcattccaagtttggtttctctatctacctgacggcgcgagtccaagatgggcagaagttttcctgactgggtgatgccattgactccgctcttgaaataactctgcgcaggaaagtctaccttgaaacgagtaccaaaagtcttgatgttgtcatcgaatcgaaggtcgccgtagtagccaccaatccaggtcagaccagtagacgcctcaatcaacctatagattgctagagtgatatctgtcttgaagaagtctgcatcgtaaggaatgttcacgaatgtgcgagtgttgttctctgtgttgagaacagacattgacttgtcgaacacttcacactcaaagccagagtcctccggaagatggtgcatgatatccgaattccaaatcgtcttgatgagatggaagtagacctccgctcggctcatgcccgtgtggtcatatcctttctcaagcgaatgccagatgatctccatcggatcatagaggacaggagaacgcgctgtctggaaccaaggcttgttctctttgtcctttccgaacctcagaaagaatccatcgagcttccaactcaaatcaatctggtcaccctcgaatttgaggatccattcacagaactctctgtcattcatttcacggaagtgcttcatgttcttccgcttctttgtctctactgtcatagctgtctcaccgttgccttaggtggcactctatcatcaattacgaatcgggctgctgcaaagtcgcccaagcctgttgtgaagatacaaggaagtccatgggaattgagcttggtgaagttgatgcgaaccatgttggcatgaacgtctctcttcctcagtcgtagatagtaaggcttcttcttagcatactccgcgacagtccagaacttgccgttgaattcctcaccattgtagtcaacctgatcaggaccaacgtagatgaaatcaatcttgccacctacctcatccgaacctgcgaacatcttgtatgcgtagatttccggaataccatacatcacagtcgggatgttacgaatatcgtacaccttcccttcttcgaagcccatttcgtataggtcaacctgtacctgatagtaaagcttggtcactaactcaggcaccgacttctgcaaacctgcaatgccacctgagccgagatcggcagcatgtgacatcttacaactcacattatacgaataattgtgttcgtcccaaaccacaacatcaacgaggttctcttttccgtgtggtccaatgtcaggcgcctgttcggctcgcttgattcggaaattctctagcttgattggctgattccacttgttgatgacgtcaaccaaagatttctcttgccgctgctggaactccttgtctcgaacctcaggtgttcctttgagtgttgactttggaacgaacctagggtccttgaagaatctcgtaacaggcagccaattgtcctgcgtccatagtgccggcggtgtacctttgacagtcagacaatactgggtcagctcatcctcactctcagattgcttgtcgccaagcataagagcttcgaccacaaccttctcaccgtcgaccttcttaccaatcgtcatgacgtcctttgccaagacgatgttgataagaatagccgcgttgtttcgtttcaggaagtcaatcgtcttgaagaacgccatcaatacgtctcatagtaattccctactcccagatagggctctaccttcagaccaagggtctcaactagcttcaggtaagcatgccccttctcgaagtagtctctcggagcattgtcacgatacagcctctgagaataaggaccccagagcagattgtgcataccatcagcaatcttctgatgatcttccttgtcgatccatgtgcgaatcaaacccaggacaccctgataagaatacatatcacaaatcgaatctgcgtcgggcttcaccttgaagaacagcttgaacaggtcacctacgttcctgatcagagcctcttcatccatcggaacttcttgccagacgtctggacgaatctctcgccacttgacccgagcgcctttcggactgaacacgatggggctgatctttttggtgacgaactttgtcttgagctggaccttagcttccctcaaccagatagcggtgatcgcccggaagatgtacttgtgagcaaaacccttgatgcctgcacgaacgtcttcccaagaactcgatcgactgaactgcgcccagttcgtgggacgattgtcggcgaattctacgagctcgaaatcgacctgatagtacaattcgatgtcttcatcataccaaagggtgacgattgtgtctaccgtgtgatgccaaccaatcagcttaaactcgctgacgaagtcctcatcttcgattttgctcaggagcgattgaagaatgccagatttttctacatcgacttggatgtcaatgtcaccataggacgatttgaacctgatcaattcttcagttggaatgaagtcatcaaagatgtgtcgagtcgaacctgcgaggtaaggaccaacgccgtcgctctcatcccagagttgcttgtgtgaacaacggttgagcgtgcgccacaggtgctcaatctttgccttccagaaatcacgaccatcctgacacccgatagacacagggcttgcagaaatgccgttgaaaatcgcgttaccgcccatgacgaatcacctctcttttatgtcgtccaattctagtggatcgagccagaacggcacagaatccttagattttgtaccgaagaatccttggtagctttaggttttctaacagaatcaggcacttacgtaggttgttcctggggaagaaatccgtataattgtggttgtcagatgtcaggcaaaaccactttaaggaacaagatcatgagtaccgcagcaacggcagcaatgaagcgagaactgaaggccaagtttggcgacaccgttacgacgggccaactcggtcagtacaatcgagagtatttgaagcgcgctcgacagggcgagctagagcaggttgctcgtggcctttgggcgatcacagcagccggtttggcacaggcgattgcatcggacgatgatgacgatgacgacagcgccgctgaggttccggagaagcccgttgatgctgcgatgattcgcaagcgcttcaacatgctcgagaagctcggcgaaggcatggtcaacggcaacattcgttcgttgatcgtgtcaggttcggcaggcgtcggtaagaccttcaccttggagcgccagttggaagaggctgagcgcaccaaaaagatcaagtcgtacgactcgaccaagggcacgatcagcgccgtcggtctgtacgagacgctctacaagaatcggaacaagggtcaggttcttctgctcgacgacgtggatcgtgtgttctacgacgaggaagcactgaacattctgaaggctgcgcttgacaccagcgcggttcggacgatcagctggtcgaaggcctccaagtacctcgcagacagcgatatcccgaaccgattccagtacgaaggtcagatcgtgttcatcaccaacctcgacctggatcgaatcgtcgccaagcaaggtcgactggctccgcacattctggctctcatgagtcggtcgatcttcctggacctgtgcatccataacccgaaggccatcatggttcgtgtcgagcaggtgctcaaggaatcgaacctgggtaaggacctcggcttggatcagaagcaggttgaccagtgcgtcaagtggatgaacgataacttgatgagcctgcggtcggtctcgatccgtacggtgaaccagctcgccggtttcatgaagacctctgccgctgactggaaggacatggcggacacgaccctgatcaagggcttctgatagtggactgacatctgacaatgcaggccactcgacaccctgggaaaccggggtgtcaccttgagtggtgtccggatcgagcctggcacaccccttagcagctctaggcttgtaagtgtctgattctattggtggttctgaacagggcttcccgtcaagaataccaatagaatcaggcagttactggatacgcttttaaaagctgagccagtctgacggtcataggactgcggtcggctcagattttaagctgtcagtgccggttcggcggacctggaattctctcgtagccaaagccttcggggtcgccaacacaggacaggagctcgcacttgcctgttccatgctgccacatgccgtagtaatagtcgtcaccgccgtgcaccagcccgaagaaggtgtaggtgtgttcacgatagcgatacagagccccaatgagaggctcgtattccttgattagttgattccagatgtctgccatcacacttcaaaccctgcgaattttccgccgccattagcgctttggaatttgtccttcagtgaattctggtctgtgacaatcttcgagtccatctgtgtgaactcacctgacctgtcatcgtccagtccatagagcgtttgatgttcaatcttcacaccgattgtgaacgtggtcttgattgacttgttcgcatatcgagatttcaactgcttgatcagaagttgattcacctgatccagttcatccgttcgaatcattgcccacataccgtcagccgtgtgagcaatacctgccgactctgcgatgccgctcatgtcaacgtctgtcgcgttcatctgaccacgattgaactgcgcagccgaccaaacaacggtgttggtctccacagccagagcacgaagctcttccgccaccgatttgaagaagtagtaggagccaaccgaataaggcagacgatacgatgcgagaatctgtaggtagtcgacgatgatcacatccgggatgaagttttgcttcatcttgagctcgtcgagcgtctgtcgaatgttcagggtcgatgccgaggtcggagggaattccttgaccttcagcttaccgtacgatttcgccttcagtgcatcaatgcgattgaggaacttctcctgaccaatgtcagtgatcttgttcatgtccatgccgaggatgttcgcgtccactcgctggaacacaacttcctctcgcatttcgcaagacacatagagcacgttcaggccatcgcgaatgtaatccgcagccaggctgaccagtgccagagacttaccaacgttggtacctgcaacgaacaggttcagagtcttgcgagtcagaccacccgaagtgatctcattgaacgtatcaattcggaacggaaccttcgactcaggattggtatagaagtcccatcgcagctgagcgtcatcaaagtagtcttgtccaacctgtgtgttgaacgtgacactgatcgcctttgcaaggatgtctggaatcgctgcaatcgagagctttgtgttctcaccctgatagactgcgatgccttcctgtagagcattgtagactgctcgttcctgacaccaggtctccgtgatcttcttcaaccaatcgaagttctggctagggataatgctgaaaatgtctgcaactgtttcaattactcgagcactacgaccctcatcaagactgcgatcgttctttgcctcgaccatcagagtcgatttgtcgggcatctcattgtacttgcctgcataggcattgatcatcttgaagacgcgcttctccgactcgtcctcaaagtattcttcctttacgaagggaagaatcttgcgcatgtactcttcattctttaccagcgccgagagaacaaggcgctcatttgttacttcactcattcggaatcctgctcaactagaccattaattctgacacgaccatgacctaattcataggtttcaccgttcttagattcaaaccaggttggatcccatggaccacgaatgcttagtgcccaggcgcctttaggatcggcatgaatcttgtggaagcagttcttcggcgtccactttggcttccaagaagggaaccaagacttgacacgaccatccttcatctcctcagttacggctcccttgagccaccaagtcaaagcattgaatgcgtgagaatggaaagcctcgcgactcttgccttcaaagtgaagcagaacgatcgagaacaaagacttgcactcaatcagccaatagccggtgacgccggaatctccgccaccatcatagctcttacgaaatagtttcaatttaatcctccttgtcttaggtcgacgatgaggaagtagaagcccataccaatgtagaaccactcgccatcggaatcaccgatgcctttgtcccaacaggtcggggcgaacgctaggcgccgccacttccaatgataccagttgccagacacagtccaacgattctcctcgttcatggtcttggccaacccatcacgttgtatttcaaatgatcacctgcaagagctgctgcatcgcagttctctttgtcaacgccgtaggtcgtgacgtgctcgtgggagccgaccttacgtccaataattatgatctggtcgaaaccatacttcttcgctacgtgctgcgccgctgagatcggaatctcgttcattcgacgacctcatgcccaagatgcttaaaaatttgcgcataaacgtaatcacgctcgaaattgtctccatcgtagcagtgagcaacaggaacaaattctagagctagctgcccatcaatgtagacgtttgctccgtcggcataactcccgccacaggtctcacagtcgtagctgtcgtaggtccactcgattctgatctgcattgtgatcttctccattcattacaatatttgccatactcagcgtgatagttgccccagtattggttagcgaccatccactcgtgatacgtcatcatcttgttcatatcttggcaatcctggcatacctaaatctgattgactcaattctctagattcggtcaatgcgaatatcagaagcgctccaagaatgaggaggtacattacgtacctaccccattgccccacaaatcattctgcacacggtgagagtacagccaaccttcatcaatgcatcgctttgcaatgccgcgcgcgattaccttctgctgttcgtcagtacaagcctgaggcatgatccagatcggaacagtgcgaggcagaccagcagcgtagtagatttccatcacttccttcacctcagcgtaatcagcctcagatccgtcaacgacgaacttgaaatactgattgacgcgtccagggaagttgtgcgtcagaacgtgctgcatcagagcaatctcagggcgaattgcctgcttacgatcctcaccactggacgagatcttcggagaattgctccatgtccaaatgcggcgagaatcttgtccaagccactcgaagatgttgctgatgaattcttccttgaacggaactgagcagttcgtctcaacgagatagtgacgtgcatctttcattcgaggatggaacagaatctcaggaatgaacttccatttcaaagtaggctcacctccagtcaaagagatgatctgaggcagaccagtgctgtagatgagcttaccctgaggaagaacctcgaacagagcatcaatcaatgcgtccgtgtcgtacttcttccacatgtgtgcgaagatcggattgactgcatactgactatcgcagcctttgtgaatcagcggaatatcttccagacgttgatagtccttcggatcgaaatcgagaggcgcgtagccctttgcatcaatcagcttctcagggttgttgaacaacggacaagagaagttgcatcgtgcaaaacgaatgtaggtagtcggatggaaggtgaattgtgcctcaccctccaacgagctgaagatttccgatacttcgaacagtgccattagccgaatacctcgccattgctgatgccatagattgcatgaacaccgcactcaccatcttccgaaacttcaacctcaagggttcggtagagtgcaggatacttcaatgcaacaatctttgcaatgtcgtctgcaatcatctcgcacgacttgtaatcaagaccgttgagtgccacagcctcttccaagaagttgaggaactggtggaactcgatctcacgatcgtcatggaagacctcaatggctaccttgaagtggaacaggtggcggtgagggtgtgcaaggtacgcgacgtcttcgagtccttgggtgccggctgctgggtagcggtgaaagcctgccttccggaatgttacccaaatctttttcatctaatggttctcctaaatggtccaactatgatatagcatccgtgacggtgaatcaacggatgctatgtctttaaccgaaaagctcttcgagactctgctgcttcgatcttaccctgtccgacttcaacacgttcttgaacgtcgagtgccagacattgaagtcagcgcgagtgtgacactcagcaagtcctgcgataggatgctggtgcgacttacgaatgcccttcatgtatccatctgcatccatgtactcttcaatctgagtgatgaagttatcgtacgaataacggaacagagcaatctttgtctttggaatgaatggtcgattgtgcgactcaccaatcgcttcaacagcagaatagctcgggcaagtgatgaaatacttgtagagagattctggatcatcgaagccgatgttgaacttgccaatgtgatccatcatgaactgataatcacgcgggcgataaccatccgactgcaacagacgagttccaacgtaggtgccgtcaggacgtcgtgtgtagaaacgcgaacgagcaagtccacctgtgtgagtggtgctatcgtagctgatgatcttgttcttgtagacgcccgacttagcgagtgccaaaacaggagcaagacgatcaaacgaaccaacacccaggaagtggatttgcttgcagtcaaaacggaaattcatctgcgaggcgacaaatgccgactcgaagttttctaggtctccaggaccaagcgtcgaggttgcgactgcgacgcctgcgatattgtccatgagctcatgagggatctgatcctggacgtactcaacccagtcataataggtctctggacaattgccttgagcaataagcataggcttagcgatcgtcccgacttccgcaaagtattcaagctgttcacgtagattctttcctgattcaattgccttagctttcagctgagagcgatcgaagaccttcttacgggtcgccgacattgcaccacgtccagcataaggatcgaagatctgcgagacagggatttcgtcgaacgacattgccacagtgctgtaatcagcctgagtcttgtagatcttgcgcttagctgcatcatcagcaaccttgccaagcgacaccatctgcagaccacctgagtcagcgtgaatgtcgcacattacgtcagcatagttctccttgaacaccttaccgaaggtcgattcagtgaacgcgttgaacagcataccgaatttgttaggtccacgatctgcaccaacgaacatgttgcgtacccaatcgatcgtttcatcattcactccgccatctcgacggagtgagttgatgtacatgaaagacgttccgcttgcgatgtagtggagttcgtttccgttgtagttatctgtcatatcatccttgggccatgatctgacccatgaagtcagcagccataaagtaagaatccaagaagtgctgcgcgttgagcagctggtcgcgctgcaggaatgcgatcaccttacttactgcttcgtcgttggtgtcgaacaggaactgatcgtatccatgaacaagctcaacgtgcgaaagacctcgagtcagtacaggcgccacgtcatacatgatagcctctacaatgcagtaaccgaagttttcctcgatagagtttgagatcatgacctttgcagtcttgagctcgttgtgatactctttctttgtcagcccttccttgatagtgatcagaccttgcttctcgtacatgcgagcgaggtcaaccaaccacttctgattcgagcggaaagtcggacgactggtcgtcagaacaatctcagtgtcaggcaatgcttccttgacaaggagtgcaaccagcaaactctgatccgggcgcttctcagagtcgaatcggttggtaatcacgatcttgttcttcttcggaccaatcgaagtcttgtcgtatgcgcttgggaagagaggattgccactcacatgaatcttcttctcaatatcacgacggtcagcttcgcttgcgaacgcgttcacacgacgttccatcactgccttcttatgatagtgcgagccgacaaagataccatcaactgccttcagccaacccagctcagtgtacttctgatagggcgccgcaacagcgaatgcatcttcagtggtgtaagatgccgcatgcaggaatccatagatcttgatttcgaccttgttgatctgtgccatcaggcgcagcgattcaatgccccagaattccaagtcactgacaaagaagaccgaaccattcggaatgctcttctcacggaacatacgagcaatcttctgcatctgagatgccttgtagaagatggtcgagttcatatccaggaatgcgccagtctcaaccgagtcggtcagagtctcgccgtcaatctgggtgaccttgaaattgtgcttggcaaaggctggcggcaggaacttgtaccactcgccggtgtagcgctcttcaagaggctcaatcggaatgatgaacagattccgttttgaagtctccggaatctggtcgatcatgccactcatgaaatcttcactcatacttcaatgtctccattaaagtcctcaggataagtgattaccgcattgcctacaacgaatgcaagaacgtgtttctcattctcaatcttgatctgatcctttggacgcaggaaatgcagagtacgagactgagcataggaagcctgcgaaacattccagaagatctcaacaccttcaggcggaaccgaattcaactcggtcaattcgacggtaacgccgataccgctgtcttcgaacacgcctgcaaggtgatgcaggtcaagctcgttgtgatgatccgaaatgtagatcatctcaatgttgtttgcgtatagattgtagatgagattgagaatatctgactcgacatattcccttgccgaacagaaataagtgcgaacgttctcgcctcgcagcataccttctacttcaataccaatcttagccattaaattctacccacctattgccattgtgaactgcgatgtagtttgtgccattgcggctgtagtaacgagtgatcagagtgttgaggaactcggcatcatcgatatcgctgctccaattagcatcaaatgctgcaggaacacgataacccttcatcactacctttcggtcattgtcaaggacaaactcgacaccttggtagtgatcctgctcgctgtaaccttcgaacaaatgatacttctcattggtcagcaaaacactctgagaagggaacagttcctgaagaacagatttcttctttgctcgaatcttcggaagcagaggttcctggaaagagtccatgtctacagtgtagaacatcaactggcaccccatatcccggtgatagtttctggccataatgctgacctgagcgtgttcagcatgagaatcacgaatggttggacagaagattgtatcttcaggtccaagtttttcaagatctttcggaagcccgaagaagtcctcgaagaaatgtggcttgaagccaaacatctcagcagttttcagagcttcgattttgcggtcaggagtgatatcgtagaaatagacaacgtcggtgatcagcccgcgatcaagtgcttggaagcacccgatcacttcatcatcaacgtgtggcgagaatacgatattcctcggtgacttcaataccttcttgtccaatatatgcccatacatcatcatcactccagtccacaatagggaaaatcgaatcattgccaaacaagccgccaaccgtatgagcaggcatgtctgctcggctgatcaactcaccattcactacaacgtctgcactgcggtcggtccgatcaaattcggaacggcgagtgccgtcaatctgaatccacagtttgtggctatccagatacttctgcatctgttcaaatggcacaatactgagaccatatttcgcactctgctcatagaggaatgctacagttgcaggatgtaccttgttgaagccggacaccttaggtgtgtgaatcagaggaacctgatcaccgaacacctttcgagctagatgatggacgacgacggaatcctttccgccgctcgtcgcaacatacacaccgtaaggatcagagactctgaccagcctaccaatggctactctttcaagttctttcaggtgctcgttcatatcaacccttgatcaaagacatcatttccgatcgcagcgtaggatcggtacggaatgaaccactcaggctagaggtgatggtcacgccatcagagtcctcaacaccgcgagtcagaacacagaagtgctgacccttcatcacaacggcaacatcttccgttccggtgatgaacttgatggtctcagcaatctgcacagtcaggcgttcctgaatctgcggacgacggctgaagaagtctacgatgcgcgacagcttcgacagacctagaaccttctcacctggcatgtaagacacccagcaagacagatcaggacggtgagcagtaccaaagtagacgaggtggtgttcacagacagacttgaccgagcagcgctcaatcaccatctcatcgtattcaatcttgttatcaacttcggtgcacttcgggaagttgttgtaatccagaccgtagaacagttcctcaacgtacatctttgcgatgcgcttcggagtctcgatcagagaatcatcggtcagatccagacccagagtcagcaaagactggcgctggaattcttcgatcaatgcgatcttctctttgctcggaacattcaccaactccgtgattggagtttcaatgcccagagcgacgaggtgcttgtgaacgcgctgaccgagttctggattggttttttctttctgcatgttactttcctttacgatttcctatatgataatatcaaccaagtgccgtttcaactggaccacggaacagttcgttgatgattagttcggtatgtgtactaaggaattcatcttcatccacaacgatagattctggattggactcttccgctttgtcggatttcaacaccgacgctttatttacaaggacctctagcttgccattgttggtcccaacatgaatgccatcgaacacgaaaaggtactgagggtgtttcaggtcgatgacttcaagatagtcttcacgggcttcttttacgtagagttccattattttagtttctctcgatcaatccatctagcattcttaggaactacagcacgtttgattgtgagtgcgcgcagacctttcagcagtgggtggctacggtttctgtctttgtcgtttctaatctgaatgacaggctgttcaatctctggcacatctttcaattcttgccagatgtcttcgacgtgaatgaacagcttgttgggcacatcttggaagaagtcattcatagtaaaggactgtctaatgatagcacctttacctttcaagatgtcatttccgaaaagggcgaattccttttccttatctgtcggttcaatcacaaggtcaggattgatcttcctgatctttgtcacaggatccatttcaaaattggtcaaggcgttctcaaatgcgtatcgcaccgatgcctcagcaatttccttgagttccgagtcagccgaagagaagaatgaagcgttgccttgcttcaatgaaacaggaatcatctttccgctcttagtccaaaactcgacgtcggctttcttgtgaccagacgtatcgcgccccgacagatagacttctacaacgcctttgatctcaaacgatttcttcttggacttgaaggtcacgtcaacaggaccaccgagccaaccgacgagtcgattgacacggtgcatcaagtattcttcattgtcctcaccggcgttacctttcaggctagccgatacaacgattgcgataccattgacgttcacagcaagattggagattcgacgagacccttccagcctcaactgaatttcgtcagcgaggcggacaggttcaacgttggctcgatggttcactgtcaaacgacgtcccttttggacaaccgttagcttgttcttacgcaaccattgcgtgatgttcgcaatggttggtggaccgagcatcggctccttagcgtagagccagttcgtcgttgttggtagaaccttcttagccattagatctcttcttcaagcacttcgccagtttcgtaatcaatcgttccagccttgatcatttcagtctgagccagctggaatcgatctttcagcttcgcaccaaaatcagtcttggtgaggatcggcacccagaatgcagcagtgttcgtatcagcctgacgatacttcttctcttcgcctgcctgctgataccaaccattggaaggcttcacgacatgtcctgtttccagtgccaggtcgagcagaccggaccaaggcgagataccgttctcgaatgttacctcgaccggaatcttgctcttctctcgtacatagcgagacttctcaacgttcaggacgaagttgtaaccaacgatatcctgtccatccttgttctgctggcgaccaacgatgtagatgttgtctgccgagtagatcagacctgtaccaccggacacgaccttcttcgcgtacatttccatcgtatcgtaggtgtgagccacgacgtgcatacagagactcttgagtgacaggattggtgtcaccattcggaacagagacttgaacgcctttgcgcgtgtcatgtctgcaaccgacttaccgtccagtgcgtcatcaacttccttcttggaagccaggttaccaaccgagtcaatcgcaatgaacaccttgtcgcctcggctgaggccatcaagctgcttcataatgtcgaacttcaactcttcgatgttggtaatcggagtgtgaacaacgcgatccagcggaatgccgaaggacgagaagtaactctgaggagtaccgaactccgaatcgtagaacagaacaacaccatccttgtacttgtcaaggaacgccttcatgttcgtcagcacaaagctggtcttgaagtgcttcgatggacctgcccagatggtcagaccaggaccgaaaccaccatcaagctcacccgactggagaaggttgaggactggaatctttgtctgcactagctctttcttctggaagaaggaactcttctccagcgatgcagtctctttgatagtagactgcttcatcaatttgtcaaccaaactcaactttcttctccttcatcttcatcgtcattatcgtcgctaaagcgtccgagtagtcctcgaacgtctggaccgatatcttcttcaccaatgtcgtcatcaacgcccatgtgagcagctgccctcttccatttgtgatagaagagagctggagtgatagaccagtcgaggacttcttcgaccgcctgcaccataggatagatgtgttcaatggatgctacagtctgtcggaacacgtcaagaatcttttcgtgttccgcaaactcagccatttcaggatcaacttcaaccattgacagttcgttctgcaaactggccaacagattcagcatctcgctagctgcactcatacttaaacccctcagccaaacaggctttcaagagagctgaccttttcagtcttccaaccgagaatgtcggtgaaggacttcaaaggagtgatgtacgttgccgtccattgcttgtccttgtccaggtactcgtgcagaccaaagccttcaggtagggtaccattgaatgcgatgttgctgcatcggcaaggattaattgccttgagcgccatcaacctcaccttgtttccgttcttgattcgttcgacagtcttttgcagacccttatcaacgatcaatgcgttgtgcgcgtatgctgcacgaacgtggtatggagccttcggcaagagttcaccgctgtcaccaatccacttcgtcagatccttcacacccttaggcgaggcaatgttctcaataggagcattataaaactccttcttgaagttatcaatggaagttagcaactgttcctgagtgcctgtcagcaggatctccaggtcgctctcgagcttcttacgaaccatcatcggcttgtcgcttcgagcagtctcgatacctgtcatcttcagaatcggctcatggtagcgaacgtgttcgttgtcccacactcgaagaacatagttcttcttaccacggaagatgccaacgtctgcgattgcttctcgcttcatgtcaagcaggttcttctttgcgccaagtcgatcagacagcttctgatatgctgcattgatgaacggtgtgaactccttctcgaggaactcgtcaatctcatcaaccgactgctgaatgttcttcggatccgaaggcaggttctccaactggatgtaagccgagtcggtgtcagacgtgatcacatagtccttatccgttccaaacttcttgttgagatacttgttcatcatgttgccgatgtactggatgcccagctgaccggtcaatgtgatgccttccgcgatgctcacgttgaagtaacggaagcccttgttcgccgatgcaccgtaaccagagttagccagaaccttcatcgcgccctgggttgcgtctgctgctgcaatcaggttgtcgaggcgcagatactcttccgaaccttctgtaccaccagccgcaagatatgcttccttctcgcgcttaaggtcgagcattcgattcttctcagccttacgagtatcgaatacgaacttcatacccttcggcataacgcccatcacgtcctgtcgataagccgaaccgtttgccgccattgcccaaccctgagctcggcaatccgcagccaggtcttctcccttcaacagacgctcaacccaatccagctgaccttgctcttcacgaaccagagtttcagggctcatgttgaacatcatacagatcgacggatacagcgaagtcaagtcgagtgacgatacccaacggtacttgccaggtacaggctccttaacgtatgcgccaatgatgctacgaccgtgcttctgcaccgccggaggaatgacgacattttctgccttgagcagattgtagatcaggttgtcccacagcttaaccttaccatccttctcctgatatcgactcttggtcatcagaacagtggtgatcacaagtcgaacaaactgcttcttctgatcaagtcgttcaaccagataaacgtctcgttcgttgtagtcaatgaacttttcgtagttctgttgatacagccccatcaggtcgccgtactcagagtaatccaacttcttctctttcagctcaacctcagagatgaaatccagtgcgtaactgtcgcgcttgaccgggttgtaacccttatacatgtccatgtaatcgagagtcgtcacaccaaagatgcgatagcccttctcagtcttgtcgtcatcgatccagtattcctgaatgcaacgatcagtgtgagcatggaacggactcagcttgttcgtcagcttctcaccgagaatagctcggcaacgattcacgatgtagggaacgtcgaacgactcaatgttccaacctgtgattgcgtctgggtcgaccacacgaacaaagtcaatgaacttctgcagaagatctctttcatcaacacacagattgtagatttgattcttgtcctttacagcatattccttcgtaccgaaggtgaccttttgaggacgtccaaacaccttacaagagatagacgtgatctcatatgccgcattctgtgcgtcagggaaaccgcccggattgcgctgaggtgccttagatgcagggtaccaacgttcattgatcggatcatagacttcccaaacgtcctggagagtcttcatgtaaccaacggtgacggtctcttcttctagactgaacaccttacgaaccaacacctcatcttcatcgtccttaccgtcgaatcgggtttcgatatcgaagttgagaacgcgatacttgtcaaactgcaattcaatcttgcccggataacggtgcgagatgaactggtgatgcatcgaagtctgtccgaacacaggaacggtgccttcatacttcttgatgaagtctttggcatccgaaatcgtatcaaaggtcattcggctgagacggtcaccgtagagcgacttgtattctccattgcctttgataaatagctcgataggaaaacttgtaacaatttcttgatggcgttttccggcatcatccacatacctgtggtaaatcttacttccaatcgaatcgcaaaaggtatagaacgccattatgtctttactctcctcatttctagcatggctagccgtcggaacaaacggcttcctgtttgctgcctcatgtgcagcactagtcttcatgctaatgattgcttatgtcttgttcaaggcaatcaggaaacttgacctcagctctatgttctacgagccgggcaccctgaccgtttcatctacaaaattctggaacgtcgttgcctgttttgtggcgaccatcgcgttcctattcatcaatatcactgcgccagcggcagcatcacttgagtttatctggcttgcgtatcttggcgtcatcgccggatcagcaagtgttagcaagctgatctcggcgagatacggtgtttctaatgaatcagctcagaagctgaatccctgatccgaattgctgagtatacgcattgcgtagctcagtcagcggttcaaacagctgcccaccgaagcgaaggtcctctggctgcagagtgatcttcgtttcatcggagaacatcaggacaggcatcatgctcagtccctgtgcacctggcgcaacgaacacgccatctgtgacctcataggtcttcttgtcgcccgattgcgagatcagcttgaagtcgccgaggatctgaccttgagtggtccataccaacttgatattgctcattacttgctccctgttgatccaaagccacctgcgcggctagtcttttgtgctggcttagtgtcaagcctcttaaatggtgccttgacagcgggcatcagcagcccctgagcaatgcgctcaccgtcttccaggactaccctggtgccactgttgttggtgaccgagacaaagatctcgccaacgtagtctgcgtcaatcactgcgacgccatttgtcagaatcagaccctgcttccaggaagtaccgctacgtgcgtgaatcgcgatgtagtagccttccgggatgtccgcgtgcaagccggtaggaacgagtgcacgatcacctggctccagatacagacgcgccggagcgttgtcctgtccacgagcagtgatttcaatcttctgattgcgatgatcgtacttgttgatcacgtcaccagcttcaatgtcaacgctcaggtcaaagcctgccgaaaactctgtcgcataatcaggaatggtcttatttcgcttctgatagaagccaaccatatcatcttcaaacggtgtaatctgtccagtgacagctacgctggacatatccagcgcgccgaggtctgtggtctctacaacttctttcttagctctcgccattatcagtatttcccagagagtatttcacacgaaggttccacttatgcttttcgcgataagggataatcattacgttcgattcaattccggtatcgacttcaaccatagaagtgatcaaaccccactgctcaagcaagttgacgatgtattccagacgatcttcatcttcatcggtaaagtcggtcacgtcggttcggccatctagcaggaacaactgcttgaaatggacgatgtagtaacgaccttgcttatggaagacgtggcatgtctgccaaagagtctgatcaccatttcgcttgctaggcaacccaatacgggtcaaagtttcacgtaccttcagaaactgatccttgttcaaaggctcaatctcgaagaaggtctcaagcagttcctgctttctgttttgcgacatttttgccacctttttctaattctttgcgaatgtcatcaagataaggtcgaagaagtccgagcacatctttggctcgtttccgactatatccgtagtattcctgaattagatcgagcgacgctgtgtcgtcctgattcttgtgccacttgccgaagcgcttcttcttcggcagaccatggtaatagaagtcaaattgtgcctgggttggaagtgcccagtaacgattcatctcattcgcgaacaagacactatcaattgtgtttgacagaaccttgttgactacgtacgaactatagccaatttcttcaacatccagcacacctttcttctcgttgatgtgcgaggcgatatcaaatggactcatagatgccattgttacctcctagatatttacacaaattcaacgtctgccatcatggtggtcaacatcgcaacggtgttgatttccttgtccatgacgtgaccttccttatagtcgtactctgcaatgatcagaacaagctgaggaatactctgaggcttgacaaagaccgtcatcttttcatacagactgcgacgcagagatgctgcatcattgtcaagatgatcaacaacccacttgcgcatgtcgctgaacttcttgcccttcaggtaatcaatcagctctttcagagcaccatcattgatgccagtctggctcgtaatctcgagaacgccgtttgccgaataacgctggatcagattccaagtcttacggaagtcagggaagttcttgatgatgacctgagtcagttcttctggagtgaaggtgatgttcttcgacttaagaactcctgcaaccttcttcaagaactccatcaacagagccttcttctcttccttcgtaaacacgatctcaacgatcggtgctcgactggtcagaggttcgatgatctggttaccgaagttgccggtaaagatgaagcggcagttacctgcaaactcttcaatcgaggcgcgcagagcttgctgagcattcttggtcagaccgtccgcctcgtccaggatgatggccttgatgccacctccgaagctgaccgtcgatgcaaactgtcgtaccgtagtacgaatcgtctcaatgttgccgttctcagacgcgttgatgacgatatgatcgattttcagctcttcacacatcgcacgtgcgacggtggtcttacctgtacccggtccaccaaccaacgtcatgttggccagttgtcccttatccacaattgcctggaagtaggtcttcaaacgtggaggaagaatacagtcattcacagtgtgcggacgataattctcactccacaggtacatttctttctcgtcactcattatcaatatctcacagttgttaaatcagcctacaaggataatttgattggctcgatgcatcaatgcagctacatacacgttccgaatctcctcagcagtcttcaacgatgcatcatcaacccaaattcggtcaaaggttcgaccgcgaaggctgtaattctcgagaaggttttgtgcaagtgcaaccaaaggcttcttgacagagttctcacccatggtcattagctggaatgcagatcctgcaacaacgaggtcatccttacatgcaaggtgacaaattgccgtcgtgtgtccaacgcctctgcccatctgaattcggatcgtaccaaattcctgcatccattgatgcggttcgagattgtggcggtacttagcattgagcgcctggcgctggaggtttagctccagcgcctgttcaagaatgttcttgaagatggcggacatattacttggcctcgacggtgaccaggtagacgagacctggcttggtcatgtggctgaactcaactgcctgatcgaacaccttgacgttgtacgaaccttcgatgagcttcaggttctcgatcttgacgagcttctcgtcactcatggagccttcggtatccagctcaatggtgatctggttgccaacgccacccgagttgagtgcggtcagcttgccttcacggatcgacagctccttcagtttcagggtagccgcagccttctgaatctggttgatgttgccttcggtcagttcaaaggtcagcttcggatcggtcagaacgatgtccttgtccggcggcgacacaacaactgccggcgagctatagaagtacttgaccttggtctttccgtcctgaatcaggatgtgatcttcattgaaggtcaggtgcggcttggagaacaggctgatcgtgcccaggaactcgttgaggtcgtagatagcgaactcgcgagtaatctcgtcattgatttcagcgacggcgaacacgttcttcagaacggacagagtgcgaagacgattgcctggcttgaacaggagaccctggttgatcgaggcaaagttcttcagaacattcaaagtttcagatgacaaactcataatttacaactcctaagtgaacaatatgtgcttatactaacaggtaggtgactgaggcaacatgtaacctcaggcatgtatcaaaatgcagcttcacctgcatggaccaactcgtccagccaacccttccaaccggggatggcaagagcctcggggcgttcgccctcaaagaacgtgatgcgctcggtgatggtgttctcaccgagttcgtacagatagaagtactgggtcaaacgcttactcatgatcttttaccattggtagtcatagaaatactgaacgtcctggctccatgttgagaaacgcaggtggcttggtccaacgaccttcatatcaatttggactcccgtcattctagcatagtcggctagatcaatacggatctctcgatatgttacctcatccgacaaatcgtagaggtaatcgttgaggacatttttacaggtgtcctcaaagaactgttgaaagaatgcgctcattagaaaattcctcgtacaatccaattgaatccgccgatatgaaaaacccttacgacagaatagagagccttgcatttggcttctctaagagtctcaacaatgtcttcggagtcggaaccgcgtgataccgcagttcctccgtcaagtggatgagccatgagacgaatcccaagctcagctgcgtattgttctgcataatcaaacgatgcgggagaatccatctactttctcgatcttcatggttgaacggaccttgtcaatgatcttctctggagtgtgcgtgacgatgaagacgttcaagtccttcaccagtgcaagcatgtctgccaatgcgtcagcgccgccttggtcaagcgagctgtcgaagatctcgtcaaagataaggatgtttgttgcaacgttgccctgcatccgtgcgatatcgcgccatgccatcagcagcgccatatccatacgaagcttctcaccttctgagaacgaattgtacccgagggtgtcaaagccgcgagccttgatcgtttcgtcgaagttttcatccaggtggaagttgacgaacagaccgaggtgattgaggtgagtgttgacctcatgattgatgatcggaatgaagcgcttgatcagcatcgtcttgatgcccttgtcctgcagcatcgtcccaatcaagctcatgtaatcgctcttggtgtagagctgctcgagcttgtctaccaacgcggtgtgcatgtcttcgagcttcttcaattcaccagttgcttccttgatcttatctgcctgactgtggcgttccttcttagtctcagcaacaaggaagtctcgcttagattcagccgatgcaatctgcatgtcaaccgatcgaaccttctcgatgtaggcatcatacttagcaaccgcaacctcgaactcagcaacaactgactcaaactgctgaatgcgaatagacaattccatcttcgccagatcaatctttgccttcttgtccgtgaggtgatcaacctgtttagcatgatcctcatgttctagcggacgatggcaggtagggcaatcctgagactttttcaactggcgcagactgttctcaatctgagacaacgaagtgtccagcttgacaatcatcttggagtgctcagacagatgattcatcgccttcttataggcgtctctgtcaatgccttcaaccgtttcaatctcgttcttacgcgcatgtagctcggacagctgagcagtgatttcgtcaatctgagcattgatgcgttcaagttctgctgctgcattttgcttgtcagcgttcttgaggtcatcaatgtacttcttgcgaatcttgatcttctctgctgcgacagtgattgcagtcttgagttcaccgatgcgattgcgaagctcggttgtctttgcattgtgcagacgagccatgttcgagaacacgatcaggttcagcacaacttcaacaaacttgcggcgctcgccagtattgagctgcatgaacatcgtgtgctgagccttaccgaccagaatgatctgacaggctgcatcatagttcatgcacaggatttgctgctcgaagatcttctgatagtctcggttgttggcttcctgattcaggagcttaccgtcctcgaagatttcaaaaatgccaggcttgatgcctcggcgcacaaggtagctcttgccatccttgtcaaattcaatttcaaccagagcatctctaccattcttagtgttgatcagatgctctttcttgatcttacggaaaggcttaccaaacagaccaaaggcgagggtgtccagcaagagcgaactcttaccgacaccattctttccgatgaccattgtcgatggtgagcgatccagctgcacttcggtcataacgtcgccgaaggacaagatattcttgaatctcagtttacgaaaatagatcacttcttcacccacagcaactttgattgaggatcaactggctcatagccttgtgctacaagatcttctgtggccattgcattcgcgaacaggtccttgaccactttctggtcaattggctgcacaccaacgagttcctgagctaattgcgcaggaaccgtttgtcgaatcatgttgattagattttgatcaatcattctgtctccgccatatccagtgcctcacgatacatttccttgaacatgtccttaaggacgttcttgtcaatggtcgggctctggacaacctcttcgatgtatttctcaatcagctcatggttgtctacgaattgcagatcaccagtctcgctattgaattgagtctcgtcgatttcgatcaggtctgcgctatagacaaccttgttcaacttctccatgaacagactcagcttgtgctgattggtcgaggagtaagactgcacgtagacgcgaacgatcttatcggtatatccatcgtagtcaaactctacgatatcaatgtcgtcattataggcgatcttggagtagacatcaaacggatttggaacaaattccaattctctcgtggtcgtgtcaaagattcggaaacctttgtcaagaccgtagtcggaccaattggtctgagatggatttgagatgtagaagatgcgaccgtcggtagagaccgtgtggaagtgaccagagtagacctgatcaaagcggtcaaacaggctcttatcgaaaccgtgttcgcagacgtgacccttgatcatttcaaacgacttgatctcgaagtgaccgcacaggatggtaggcggacagttcttgatgaaatcaagactctcagcgaggttggcgttgttcacccagctaaggaagttgacaggtgtaccatcaaactcaattgtctcgtgtgtcttgaccacacgaatgttcttgtacatctttgccaagaagtcgatcgagttgatatcgtttcgattcttgtaggcgacgtcgtggttaccatagatgatggtcacctggataccacgttcctcgagcttgtcaaggtacatggattgggcgcgccagagagtaaccacgtcaatacgagttctgtattcccagaagtcaccaagcatccagacatgagtgatgcccagttcgtcgatggtagggaagaagatctcattgtagaacttctcgtagttgtccaagaagtacttagaaccattgcgcacgccaaagtgctggtcggtgatcatagcaattttcatatgatcacctcagtggttcatgaattcgacgacgtcgtagttgtcgatgtagtgactgtgatctccatccatcgtcgagaagaactcgttgacaggatcagtcatcatgtccatcttggtcttctggagcttcttctcgtaggcaatgtagcccaggaatgctcgccatacgcacagggagatgaatccgaacgggttaacctcaccgttcttacccaggcgctttggatcgaaggagttcatagcgcgaacggctgcgatgatgccttcgcccttcatctcttcgatataggtatagttacggaagttgggacgtgatgcctgaccttcagctaccttcatgattgcatcgcctaccgaatctggtaggggaggtgccttcttgcctgcagcgattgccgtatccttccgaatcttccattcacacaggtcagcgtagagtgcctgcttgtctacatagtgatttgctttcttcttgtcttcggtcaatgctgaaaatgccgtattagtgaagtgtcgtagatctaggaacttctcgagacattagaatctcaaagtgttcatcatcaggggtagacgcaaccttttctctcaacctgatcacgccggtgtaattactaaccacatgctctgatgggcgcacaatggcgatcatctgattgttcatgaagggaaccggagtcaaatcaagtggattgaaatatgccatctgatccaggaaaggcgtgaactcatatccttcaacattgtctgtgcgttcattgtaatcaactgtgaccgtgtagggtcgcagaaccatcgtagtctcagggaagactgcaatcacataaccaatgacattcaaaccgttttggaagtgcattagccgaatcggataggccttacccgattcgactctgaccaaatctactgcttcttcagtactcattcttccatcttgatcgggatgatcttgtacttccatttctcacctacgtagattttgagtctttctaggaagtggcggagaatcgtattctgcttctttaccccactgcgtgtagtataggataaatcgtctgcaatatcaatgagttttacatcttgtttcccttctgccgttcgaaggattcgtccaatcgactgaagagttcggatgacggctttgatcgggtgacagaagatcagattgtgcaggttcttgacgttgacgccgaccgccagcgtaccgtacgatgcgagcaggatggcgttgttttccttctctaggatctgacggatctgttcacggtcatcaactgcggtcgagcctgaaatgaagtacagcttcttgccatacttctcacacattggcttcatcaactcatagagtaccttaccatgcttcgcaacatagttgaacagcatcaaggtgttacccttctgaatcaatgcagtctttgcgagcaggtagttgcgcttaggatggctaacaaggaacttgatctcgccatcgtagtccatgttctttacgaggtcaacgtcattcttgctatacctcagctgtaggcactcaatgttcaatggagccagagaaccttcatcctgcaggtcctttgtcgaggcaactcgtacaatagaaccgaatcgagcctgcatgtcaagctcgtgcatcttggtaccatcaagagtacctgtcagaccaaggcggaacggagcatggccaagctggtcgatgatctgagaaatgctctttgcgtctgcaccatgcgcctcgtcacagatataggcagagaaggactggaaccatgccttaggcagcttgatagccgactgccaggtggagattacaacacggtgttcggtgtacttctccttaccagagtagatacggtgaacgttctcttcaacgtcccaatcgtcagccacatagtccttgaagtcggagaacatctgctcgacgagcgacgttgatggaaccgtcatcaagaccttaccatcggtgtggtcgagcaggtaacgtgtgatcagatactgaatgtaagacttacccgaacctgtcggcgacagaatcaaggtcttggaatcattgatagctctaaagacggcttccttctgataccatttaggctcaaacttgccacacttcttgagctcgttccaggactcttcattgatggttgggtactggcgctcgaagtccttcggattcgcgtaatcaatggtgtagccgttttcctcagcccactcaaagagctttggcaggagaccaatgtagaagttgcggtccttgatgttgtaaaggcgtaccttaccatcccaacgacctgccttgaacgcaggcatgaacttgtatccattgacgaagaatgcaaacgcctcagagacttcataggaaatgccgacagagcaatccagggtgacgtgtaattcgttcttatagtgaagtttgatatctgcttgcattcttcgtgcctaggtcatccgccgttcttgaatctcaggaattcaatggagttcttaatgaggaagtttcttgtgttcaatgtcttgatgaaggcttcgagcatctcagtcttcatcttttgcagctcatatttcgatttcagctcagtcaacttctcatctgcatcgaggtacagttcaaggtcttgcctgaggattttgatgtctttaggctcagccttgtagacttcatcactcgcctgtcccagccaatactggtggcgttctttcttcacacgcttatattcaatctcgatgcctttcaggatacgaagctctgcaatgaagtaattgtagtacttcgagtgaagcattggaatcctcaaggactccgtatctagggcattgttgttgatttcagaatctgcagcaatttcagcttggagttcgtccagacgcatcgcgaataatctcaaagtattgataacggaatgttgcggagcagatcagaggtgtcgtatcgttgacgcccgaatcaaacgggatagaactcaacatcgtaggatacgccttgtggaatctaatctgcatcttatgattgcgagacgagttagtgatgtggagaacaatgttcttcatcatttcagggaccacaggctcggtcatggtgatctgaatcatccactcatagagtgatctgtagttttcaaaatcctctgagacaatgaagttgatgttcagaggatcaaactcgactctattactggggacgttcgtaccccagttttgatatgcggtttcaacaccacccgaagatactgacggaatttccgtagactggacggtgtagttaagcgtctcaaagcccggaatgtcgagcttgtagcttgtgcctagcgcaggatttcgattgatgtgtttactggtcatgccagtatttaatcggtcaatctcaggttggctacgatgttctgtgcaacaatctggagagcatccaatgatccggagttggtgacgaccaggtctccatcctcaaaggcaacacctgcctcagaagcgtgcgcagccacagacttgagacctgggcgttcaatgtggatgagcaacccaccattgtccctgatccatgatgcttcattttcaaagcgaacatcagtgacgagaagacctgccttgcgagtttcatcgagcctgatcttagccatgtgaatccagatatcatcacggagcatctgacgcccatactctgttcccatcaattgcattgcacgacgcggactgaaaccccaacgaggatcaatagcctctttgaactctctgtcatgatcaatctgatgacgagtccatccgaacaatccgcagcaagcatccttgagtggacctgcaaacgaatatggttcaaagttgatgaccttgttgatgaaacctgcaaaggtatccttgcctgttcctgccttacctgttagtccaatgagtctgatcatacattgacatccatgtgacgaacgaactcttcaagctcatctagagtgtaggaacctttcttgatgtcttcaattcgattgagaatgtaatcacgattgtcttcattggcatcaacaatgtcttccgaaattgccttccatgatagaacgtcttcttccaattcagcaatgcgatctacttcgcgttcaatgaggctaaccacattagggtccatcagtgtccaattggctgctacaaagtctgccaatgtcattgaagaataaaactgcatacgcaactcctagtaatatcaagggttctacggcttttcaaaattaccccttcatctactgaaacctagtagtatcaagggatctcactttcttgcttaaaagctacaccttccacgtgtgtctatgtactacacgccgaatcttttagcctcgggcacgacacctcggtggcatctatacacctttctttattttctttctaactttctttctatttgctacccatctggttcaagagcattttaacagtcaagaaagatgcatcatagagatgtacgatcattgttcgtcaactttttacgagcacagcgagctttagctgcctcagacatgcgcttcttttgctcctcagtgcgaggcttatgcttgatgacaattcccagctcacgacgttttgcagcagcggctaactgtgattgacggattcgctctacttgctcaggggtgcgcttgcgaccgtattgagggttgttctttccaaccttaccgtacataggattcttttcacctgaggttgaatcgctaatcttctttttatgttcctcagacttcttgttgtagatgccacgctttatctttgtctcctcgctctgcttgcgtcctttaactgcggcgagttgtgcaggtgaaccaccctggggtctacctgagatgttttgattgagccatttgtcgttgatatgagccttcactcgtcttaggaactttgtctcaaacaggtaagcctcatccttagtctcgaattccttgtgaactcgaatcacatcagggtcaccaaattgtgctacaaattcgtgaacatagatagaggaagtcttgtagacatgccagaggtcgtattccgggatgaccacgttcgcacttctcatgccgtaatagtatttgtttagatcggtccagccgattaggtaagtgtatgccatagtcctatgatattgcctttcacctatagactatagaaaacatagatattcaaccaaaacaaaacccgccgaagcgggtcttgtctgaaatcttaccaccgttgccggtgccaagtccctcactattacatgaggttcttgaccaaagccttgcgatagtaataattcgcgttcgaaccgatagcggtcgagttgcccacgaatgggttctcagccattgcataacgggtcttgaagcccagagcagcgtggaagttgcttgggtcggtagcgcggtgcagttccagaggaatgtatggcgcgtagtacagacctgcgtcgtactgagtcgaacccttgaagccgaccaggtaagcatcggtaccgaggtacggatcgatgtagaccttgaagcgacctgcggtaccggcataagttgcaccggttgcgtcaacttcgagcgaaacctgaccctgaagggctggagcgtagtccagaacgcctgccatcgcgagtgccgaagcaacgtcggacgagacgatcaggaagttacccttaccacgacgggactcgattgcgatcgcgttagcgtcgcgctcgatagcgaacagcagacccttgaagcgctcaacagaccaacgtccgtcagcgtcagcgttcaggtcgaaggtacctggggtagaagcaaactgtgcaccgaccttagcagcgttgtagaccgtacgaacaacctgacggttgatttcggagatcagttcgttgctgaggatctgaacaagctcagcatccgcatccagaccgtgtacgcgcttcatgtcctgagcaagctcaatggagtagtctgcacgcagctgacgggtggtcgccgagatgttgaccttgtcgatggtgacaccgaccgagttccatggatcaacttcgcctgcgcttgttgccttaccggtaccagttgcgaaaccagtcaggaagtttgcgtcagtgatagctgcatgagtaccggtaccaccgtaggaggtatcagcttcctgcagacccaggatttcagcaccagcctgaggaccagtgttcggcggggtagcagcacgacgtgccttcagtgcaaagatcagacccgacggagcggtcattggctgcacaccgaggatgtcatatgcgatcagcttaggagccatacggcggaccatggagatcaggacagggtcccagttctgcacgccggcggtcaggttcgaagcttcgttcagtgcttcctgtgtgttctccagaagctgagcagttaccttcttgcgatacgggtcagtaattgcatctgccttttcgctttcaagaactggttcccacttctctaggagggtatccactttattttcttcttgagacatcttttgttctcctaaaaatctcaaatacgaattaaacaattctcagatatttatgttctgggaattcaacttacagaagacccttgcccatcaggcgcaggacatctccattgacttccttcttagccggcttagcttgctcgttgagcacttccggggtgtcggcgagaggtgaaacctgtgctggggcagccacagcctttgcctgctcaacgatcattgctacgccgtctttgtactcatcgagcgaatcgaacgagacagcctcaagcaattcatttaccttctccttctgagtctcagccagatcagcaactgcgcgctccaggatcagagtacggttaagcttctcgagctcttctctagcagcagagaggtcttcgaagagcgactcatactgagcggtggattcctgcagggattcctggagctcaataacagcagcatcttccttaactgggaacgcattcttctcaaatgcttccttgatgaactcgaacgcagacttcatgcgtgcgtgttcttcggtctcaacgaaacgttccttattctcagtgatgaatgcatcaactgcgaactcagcgtattccttggcctttgcgatgacagactcctgaatcgactcgccgtaagcgttagcctttgccttcaggtgttcaccatacttgtttgcttcttccttcaggaatgcaatttctgcctgatgtgcttcttcaagggcttctttgtccttctcagcagcttcatcagcttccttcttgccctcagccttaccctcttcctttgcagccgcgaatgcttctgtcaggatggtctggatctgagttgcggtgtcttctgaaagctctagggtctccagaagttcctttagttgttcattcattacttactcctaagatctttcagaatgatgttttaagttctacggtatttagttctcagaaattctcagttttcgcgtccattgctgagagcgacgagcttcttgaacagttcaatcatcttggcttcgttcagtgtacctgtgcgagctgcgtgattgatctccttcttaatctccacttcacgttccatcaggagaccgttttcccaaacccattccttaccttccatcaggttggtcaggtatgcgtctggcgccgacgggtcagagacgatatcgcctggggagatgagcctaaagctctgcaccacagcagtcttctgtccgcgctgctcgaacatcttggtcttaccaagagcacgagttgacgtacccatgttcacgccttcatccatcagaccagcaacgatacgtccgtttggtgtgcctgtggtaacgactgcgcgaccgatccagttgttgccgtcctcagtcagcgactcgtacttgtgagacacttccttatagtcgttacgcggatcgtttgcaggatgattgagatgacctactgcacgtcctagcgcaatctcttcgcggatgaagcgatcgatctcaggcttgatcagttccttcgggtaaacgcgaccattgcggttctttacctcagcctggatgctgataccttcgatgatgtacttcttgtgcttgattccgccaacttcctcagtgaggatctcattacgaacatcgtcaatgcgttctactagtacttgcatttcctgttctctcttctacttaatagccgtgcttctgatcttcgatcttttcagcagcggcgatgtgatgctcagatttctcgtggtgttcggcagccttcttacggtcaccgatcttatcgtgatgctgggacatcacagcatgtccacgtgcattgtgcttatgccaatgcagcgtgttttccttgtgccttgcagccttgttgaagtgatgcgtcgccatcatcgcaaggttctgctctgccagatactcttcgaatctcattatcgacccaacccaaatgacttacggaagcggttagccttgcgggtcttgcgaataacgcgagccttgaacgactgacccatcgacttcttagtcagaacagcacggcgcattgccttacgcatcacagcaacctgagcgccagagatcttcttacaggtcttggctgctgcatcccacttgaagccagggctgcactgcatcttgatgcgcttcttaccgcggaagtttaccttgatcttacggcgaacctcggaaaggaatccgttgtcggtgtcatcgtcccattcaaactcgtcaccaacctcgaggtcttcagcaggcagcatgactagttctggatcaatgtagacatagacgttgaactcgaagtccttgtcgaacataatgtcgccgaagtcgtattcctgatcttcgacaaagccatgaacgaggtcttcgcgtacagcttcgatctcataggtgtcaacaccatcagcgccttcgaggtaggtgcagtagtcttcgcaggccttcttattcttgaaggtaagcatcagaacaccggaagcatatgctccctcgtccgaaccaagctgacgaccattctcgcgcagagtcagaacaaggtccttctccgcatcgcccatggcggtccaatctgtgtctgtagtgtccttacgaacatgctcttccagaggcagtggagggcaaacctcgccgctctctagacgctcttcaaggacgttagccatgtggctcttcatttccttgatgaagtcgtaggcgttcaatttgttgatatcaattgccattaagcggctccttggttttcatcgaatgggaatgttgtcgcctggctggatgtcagcgaattcttgctcctcaccatcatcagactgtgccggtgccgctcctgagaactgtgctccgttgttgccttcgccttcagcatctgggtcatcatggatgcctgctgcgtgttccttttcaagctgcttatcttcctctgcaatttccttgtcggacatgcgaaggacgttcttctgaacatacagcttggagaaatacttgcctacgtgaggatcgatagtatttaaagtattgagacggttgttgaggatctctgtttccttcgcttctacgaaggtattgtcctcagtgtagttccatacaatatcgcgcttgatatcgttccagtctgcgtctgtgatgatcttcttgagcagcaggttggtgcgcaggatgtcttcaagtacaggaacgaatcgagaacgcagcgtatgcaggaacttggtgaagcggtattcgtcacgggtgatctcgttacccttaccaaacaggtttggtgcctgctggtcaccgaagcggctacgtggcacgccaagtgaacgccagaacttatcgcgcaggtactcgatctcatccatgatatcctgagagttctgaccttcaatggtcgtaacctcagtggacttgccttcacgacgcggaagccaatagtcttccaacatggtcatgatgttacgacgatcagacagctgtcctgtcttcgagtcatagaccatcttgttcttgaacttggccatgaggtctttgatgtaagcctcagccttgttcttttgtaggccagaaacgtcaacatagaaggcgcggcgtgcaggtgcacgaacgacacggaagatgatcatcgcatcttccatcatcttcagcatgttgaacggaacaatcgacttcttcaggtaaccgacatatcgacccaggtttcggtcaaacagaccagagttcacataggtgatgctctctggacgaatctgaataccttggatagatgtaccatgctgaatctggatgacctgattgagcgggtgcgccttaggatcgaagttgctatagagatagaactgcttcaccttggaagcatcgtaggttccatcaggattcatcttaggcatgacgcggacaagacggatcttgagcggatcaatgaactgaaccttctggataccctgctttagcttgttgtagtccaccatcttgtagaggtagatcttggaatcgacataccagtcatcgaaccactgagcgccattgacgtcaaagtcggtgatcttgtatacctcatcaaactcggatgcaatcttcttcttcattgcagcagagagcttggattcctttacaaagtcgagttcaactgccttcttgccagggacgtcgaagatgaaaacttcgtttcggatttcctgcaaggcttcatcgacctcagcagtagctgcaaggtcacggtaagatcggatgagctccgcttcgtcagctggagtttggagcaactcatacgggacagacatgacgcccgcatggtcattgtaataagtctcaggaacgacaacctcagaggtagtctcacggtcaatgctgaacgtggttagctcttctttaggtcctgccttcttccagagttcgtagccaaaaatctgcattagatttccttcatggtttcacatgatatttaatccaaagaaaagcccaggtatctcactgggctcttcttcgttccatggattagaaacgagtagcagtagattcccaaccattgattgcgaacgtcactggctgcagagcgatctggtcgttctggtcgtagcccagctggatttcgccaaccattgttgggaagatgccgtacacgcggtaacgctgtacttcctgatccgcgcggtccagagtgatgatgtctgcctgtgcatacgagaagatcgggttcagcatctgtggctgagcaacgttggtacggaaaccaagcagctgatcctgccactgctcaaacaccgaacgtccgaggaagtcgttgtcgaggaggatctgtacagtccaatcgccccaaaccttgtcacctgggatctttacctgacgacccatgtaaggcacgtcaattgcaccgagtgtggattcaggaatcgaagccgactggcaggtgaagctgatcttggtagctgcttcaacagcgcgaccaatggtcagagggaaggaaatgttgacgcggtaacggttagggcgagcgccgccgccacgaaagtttgccaagaaggagtagacgtccgcctgtgccatgatagttatcctttaaaagttgagttagttatgattctctatggacccaaccatacttctgagtatcgtcagtatttagtttctgacgaagtagtgagcaccgccatatttctcaccttcatacttccaacccttagaggtgaacatgcgaaggaaagatggattgcggatgaacttgtcgtataggtctcttagaccgtattcttcgtcaccttggaatacgagttccttaggcttcgccttgtcgataaccttgagtaggacaaatgcaatgcgattgtagaaatccagagccaacttggcttctcgagcaggcttgatgccaccgtaatgattggtgaaaatgatctcaccatcctcagagttgcaacctaccgtgatgcgctgaccattatactcgaggtatgtccaaactcgtccatgacctgtgttgaattgtccattgtcagctttgtcattgtttccaaaaggtacctcacgaaaaccaaatgcttcggctagatattcttcaaatgtcatacttaggttaccaattgtcatcgttctatttagacaaaagaaaagccccggtttcccggggctcaagaatactacgagtagttcttcttagaatgtgccaccgaccacttcgtcgaacgagacgtcctgacggaccgcaacgaagttgagctgtacccaattgatcgagtagacaggcttgatgaagatcgagccgacgaactgacggttcatgatgacctcagcggtgttgttcgacgtatcgcaaacaacgcggaagtcttcaataccaccacgaccgcgaacctgttccagcttcggcgaaaccatgttcacgaagttgttacgtgtgaactcgttgttggtctcgaagaggtagtacttagcagcagtcgagatgtccttctccagggagatgaacagacgacgggtaccaatctgaccgaatgctgagttcttaccgagcagggtcttgtctccgtagagaacagttccgtcggtgttgaacgtgacaactgggttgataccgaccttgtagatcgcatcacggctggtcttgttcgggttgaacgccagcgagacaacgttcttaaggcgaccgcgagtgtaaccacctgggctagtccatgggtcattggtgttatcgacctgagcacacagacctgcaaggtcagcgttcagcggaatccaacggtacttgtcgttgtagacgtcgtactggagtttccagcccgagtccatgaccgcataggagcttgcgcgtccaacgaggttacgagtcgatacaacggcgttcactgcgtcagactgagtcttgttcaggacgtccgaaagctgcggcgagtagaacacaacgcagtcacgacgggattcagcaaggttgtcgattgcactctggacagtgacattgtgctcagtctcaccacctgcatcgccagtgaagatcaacgatacgtcgacttcttcctggttcgagaacagatcgtaagcgcgagtcaggtcacctgcagtgatagcagtcgaatccttaccgccggtcagcggagcagcctttacagcagccagtcgcttgtaggtagttggttcgcctgcaacaacacctggaacgccccaatcggatgcgtcagagatagttccaacaaccgcagttgccgtagcgccagttccgccaccacccgagaaggtgatcgtaggagccgaagcgtagccggaacctgcattggtaatggtcacgccagtcacagcacctgcagcaacagttgcggtacctgtagcgcgcacgccgccagccgatgggagcgagaatgaaacagttggagcagtcgtgtagccagtaccacctgcgccgacagttaccgaagcaaccgcgccagtcgaaggattggataggtctgcgccagttggcatcgacagcgcccaaacgtacttagaagtacggttcaggacgttgatgtagaagttaggaccgttgtttgcgtccttagcgtccgaagccttcgacagatacgagaaggtctcaagcaccgaaccaaccacaccggagaacttaccctgcttgtcgatgattacgacgtggagttcatcgttagcagcgccaagggattcagcccactgcgaggaacctggagcagtgtcgaacagatacgcatactgccagcctgcgaatgtcgcagcgtcagccatgtgaacagcgatcgagtcgccgagcgaacctgggaactttgcagcaaactgcacagtcgtaggagcagtcttaacgatctcaaagtgatttgagttctttacaaggaagccgttaccgtcatccgaagagttgattgcatcttcgtctgccgcacggacaatcttcaggtcgccagtgtaagcgaggaagttgaatgccgagaaccaagaaacgtagttcttgtcgtttggcttgtgataggtcttctcgagttccagcggagtagaaactgtcgcaatctgctcgaccggtccccacgcaaagtcacccgcaaatgcaccgcccgaggtgccagaagaaccaacaatgttggtgaggtcagtttcatcgaaaccaactccagggcttagattagatgatgccatctatattctcctgagatcaaaaatcgtgcttcatgtaagcaatatgtctgagatatttatgttctcaggttagtggaaagtctccaacaattcctcactctgcttgccaaagccgaagtcgaaaccatcgtcagtgccgtcgtccatgaatccgaaggctgtgtgatactcagcgtcctgaaggatgttctgtcgaaccagatcacgggtgttctgatcaaaagtatcttcgaagtaaggctgagcggagaaccatgcaaagattacgagtgacattacaatgtcgtcgtactttcccttctctgcctcatagcttgttcccttcttagagaacgagttgagttcctcgatcgtctcgtagtcgttgatgatgagctgattagactcaatcaaacccttgagagtagaacaaccaatctgcttggtcttcttagtcgtcttgacaccaggtgcaatgcgttcattacgagcgcctgagatcttcgcatcgttgtttccgccacgggagagaagcatgttctcatactcgtaatccatccacagggcatcaacaacctgcttaccgtaggtgtttgactccacgatcacgtagccatcgttgtacttcttacctgtcttatcaacaaggtcagcaagcagcaatggagacatgatgttcgatcgcatcatagcgacctgcttatatggcgcctcggtgacgtcaataaccgacacaactgagtagtccttaccaacaccttccgaaacgtcgacggtgatgacgtagaagtgtccaggaatcggatcttcatagatcttgaattccttatggtcgccaagcaaacgaataggattctggaagaccagtctctgaagggtgctaggcgagagcagcgtatcagacgaaccttggaactcgcacatgaattcctgattaaactgacgctcagacatgttgcgcatctgctcatcataccaagccttgtctcgcttaggatgttcgtgccagagcgcgtcgtcccagacatagttgttgtcaccacgtagagcctctgtccacaacttgtagaacaggttcataccgttaggggtagacgtgatgatgatcttggatgtatcacccgaagatacgaccggataggtagcagtgtagaactcgtggtcattatcaacccacgcgaactcgtcaaggtacagcaggttgacggacttaccacgaacacctgaaccaccggtagccgcagtcacaaccttcgacttgttacccagctggatcgaacccttgttccaggtatgaatgccaggctggaaccaccatggcagacactcgtacatttccttgatgcgatcaaggatttccatagcctgaccacgctgctgtgccagcacgtagatgttgtacttcttgttgaagattgcgtaccacaacaggacggctgctactgtcgtagtcttacccatctgtcgaggccaacgcaggattgagaatcggttgcctacaatcttcttcatcgctcggcgctgatagccgaatggaacaaatggaaccgtaccctggtcaaggctcagaatctctacgtaattttcaagaaaatactcgaagtcctgtgagcacttatacatttcctcagcctgctcaggagtgagctcgaccttaacgccagccttctttaggttgttgagaccattgtactggtcttgaggattgatcgtcccatgatatgtcttatcgaatttcatattgtttccaagtcttattgtccaatcacaggtaaatcatttaccatatgtctgtaagaatatttaccaattgtttctcaaaattagatcagaactagccgtcggctaagcgtagtcgcgacgtgagatagagtctgttgagtgttgtaccagagacaattcaaagagcctttacggcttaaagtttgaccagctctgctactttgcaactggtgtgttcatatgctcagagactgtgcggcatatggactggcgggattgcttaattgcaccaatcctgactaatagggcgccaccgattccccgtgtcctgtatagggtcagaccagtcttgtgattaaccccttaatcaccatttgagccagcttggccgaattgtgattaaaattcaaggttcagaaagacattatgaccactatgaggagactcgtcagagtctccgaattccgaacgaagtgaggatatgctccgaaggctcttctgagtccaatggattattgcgtctctaccgttgtgcattcgccttcgatgacggacgatgcttgagcagccttagcagcttccttcgcacgcttatccttctccatcatcatatccaagaactcttctgtagaaccaatgaagatgttcgtcgtagatccaggagcctgtacagcttcttcctgtggagagccgggaaccatacccttgcccttaggagcttgtttgatgtccttagacagcttagacaagttgatgttgagattggctgctgtgtttaacaggtttgccatcgcattgatcatcttgtctgactgagactgtcttgtgagctcaaccacctcaggtacatattccattacctgagtgatcagttccttcagattagatcgagcctcctgatagtcatcttcaatctcaggtgcttccttgaactcatcaaccttcgcaatttcttgtgatgggcgaggaatggtcgcaacaggagttgcggcacctagggattgtgagatagcatcaagagcgttcatcattacagcgttccgacgtgcttaccgttgtggtataggttatgcgcgatatgagagttcgggttattcttcttcaataggtcatggtgagcacgagcagctgcttctgatgcgtgagacttacgagcatcgtgcataccactttccttaccagacttgttcagagcatgagtgtgccactcatttcctgcctgagactgttcacgacgatgttttgcaaggtcgttatgtgcgtgcttccatcccttgatggcttcacctagaaattcttcaaatgtcattgttattcctcgaattgtgatccgtgcgtgtctacaatcgtatgaacctgattaggaccagcttcgattggtgtgactgtactcgtgtatttagagaagattctttcgtagtctttgtcaccaaagttaagaatggtctgcttaatcatgttggttgcacgacgatcaggatagtagtatcccttcacggtgaagttgagggtccacatgatcgtacgctttgtatcaaaggttccttcatattcgatattcagcgacgtcgagttcaatgtgacaggaaccacagtctcaagctggaagtcttctctatcacgaatggtcacagacagctcaggagtgaagaaaggaacgatctgttccagaaccttcagagaatcttctagcttgcgagcaccaatgtagagatcaaactggagatcataagggacacggttataggtcatcacctcttcaccgtcatccatctgatcgacaatctgattcagtgcgttgagtgctctttcaggagcatagttcataccgacaagctcaaagcccattcgagggaacgtgatgtcaatgtcagtctcgcccatactcttactggagtagatggcttcaatgaacttctctttctgtgagaaaatcagaggcaccatatatggacgaccgaagtcatctgtgacctgaatctggtcgaagatcgtagcgaatgccacgatcagctttttagttgtctgccaatagaagtgaggtcttgacattagaagtcaccccatgggttgtttcgatcaaactggtcaataatgatccctgtcttctcagagatgataccttcattgacacgagcaggagcctcactgtcctcagacacggtttccattgcatcaagtgcaggcttaccggtctggaacttctcacgagaaccagtccaggtttcgcaaaccagtttgtaagtgaagtggcgaccaaactgccagtcaggctggttgtaccatacctgattgatctcgaatagagtgttggtcagagagaagtcgggatcatatggattgccgacatagataaggtcaccttccattggacgctcacgaccagttccaagctcggcgaacctgcgcttggacatgatgaagtcagcagtctgattgactcggaagccaaacttggacatgatgttctgctcacctgggtaaccatatccatcaggctggtaagcttcaatgatgaagttgcgacggaagacagtcttcttcggctcctggaggatcggatcgacctcaaagatttcgcgaggaatgtagagaacgtcctgaccgttcatctggatcatctcaatgaccagatcctcgaagagttcctgttcggaattctcgttcgcagtgttgaagtagcggttcaaggccatgataggatctcgaagtgattaatgttcgagatatttaacctacgaagaaattcggcggctcttcatacatgtcgtggagttcttgtttcagcgtctgaatttcttccttcgcttcatccatgatctcctgagcgttcaactgaacaccaccaggtagctggacattggagaacttcacaaggttcataccccactgcttcttgatctgtgcagtagcatacttcttgagccagcggttgttccagacatcgccagaaacctcaggcatcacacgacgatagcactcaatgcccatccatgaacctacggtcagagcatcccaatcaccgaggatgtagagcttgtcgtagtgctgattgaactggattctatcctcagcagagaacgtatcgttcaaagtgttgaggtaagattgagtgatgtagtaagccgacagaccatcgccttgcatgatgcggcgaggattcatgatatctgtgatgtactgctgatattgcaggttgattgtagcgatgccgttaccgccaccgtccagacctgagcctgcattgatcactcgaagaacagactgagtctcaggcggaagctgaaggtaaccaagctgcttcatcgactcggtcacttgaactttcaggaacacgagttccgaaccgtctgagtgatactcccagaacaagtcaagggcgtcttcaattcggtcatcgacctgctgaggatcaacgttgatgcgcatcactggcgcaccaagtgctctcaaacagtagtttgtgaactcttctctcgagttgagcttagccatgtatctgttccagatgaattttcgattttatttaaagcgatgctgactcgatcaatgaggtcagaactgcactgctgttgctggacagcggtgatcgtctgtcgtaccgttgcttggtacgacattagacgaagggagatgtcatttagattgagcattttggagaagtccaatcagtgtgtctagcttagagtgaagcccccttacctcgctctctagattgtcgatgcgctttgcttgttttagacgtgccttagcgcggtggtactcgtcagtattggtgttaaccactcctgctccgcgcttgataaggtccggatagtcttttactcttgcgtccattatgtgattgcgattgctcttagcgattcaaagaggacaggcttggacgagttcttcgagcgaccaacaagtttgatcttgaaggcagtgaatggctcatcagcccagccggtgtagttgacgccttccgaggtgtatgcggtgcagtgctcagaagccacaaccttgtactcaaccatgtccgaagtgtcgaccgacgaacgcgacttggtcagagcgtttgccttgatccaaggacgtgcctcaatcgaacccgaagcgtagactggcagaaccttgaagtagacatcgaagtctgcattgagatctttataggcatcgacataaaggtagaggtcgtttgcagcgttctcgaggttgacagtacgagtgacatacttgtagatctcggaaccattgacaatctcttcctcggcatgccagacaggctgagatgcgtcgtatggaatcgaagtcatcttcgccttctcttgccactcggaacggttgctgatcaggatcgccgagaaggtgtccatgttaaccatcggagtgctggtcgcatctgtcgaattgaacgatgctgagacagtcaccgaacggttacctgtaccaagcatgatctgctcgttgtttgcagacgcaatcttcagaggctgaccaaggaacttgtcttcctgaggaacgaacgagattggagcctgagcctggtagttagcagcctcaaagatgcttcccgtatcgccatgacctacgcctgtcagagtccaagactccgaagaacggtatggcaggtatgcacctgagacgttgaacacgtcaaacttaccaccaccgttgtagcaaatgatgccgcttccgccaaagcgtccagtcatcgtagctggtgtggttaggttgatgatgaacgagtcaaccgagcatacttcaacaatcgagtgacccagagaacctgtgacgtgctcagtgttgaactcagacacagggatacctgcgatagtaccacctggatacttcgcaccgtacgagttggtcacaaccgtaccgaagcactggttgagtgtgtagctggctggcttcttagtgtcaatggagctaatcagataccagtcacgaacctcgcgagtctttgcatcgcaggagtaggtctgaccagcagtgaacacaccggagatatccttgagtgtcacttcatactgattggctgtagcggtcgacttgatgtctgagatgatgcccttacctgttgtggtgtgcatcgtctgaccaacctgcggaacgaagtccgagacattgatcgtgaacggtgtatcacttgtgaggctcagcgagatacgatcacctgtggtcagtccatgatcacgcaggaacacgcgcacgcgcgactggcctgtctgagtctggaacggattttcagggagaacgacttcctcatcttcatgagcattctcgaacacgaggttcatggtacccggagtgaagtttgccttgtagagacgatacttgatctgctcatactgctctgcattccaagtcgaaccattgagcgaacggaagctgacctcagtggtcgtctgctgctcaacaatcttacctggcatgttggtcacttcctcaccaaggcgcgagacccataggcgtgtgttaggcgaatagccaccaacaacgaagcagtactgagtcattgactcaaggaacacaggctgatcgaaaacaaccttgaatgccttgctcgaatcatcagacgcgaatggctggatttggtctggactgtagtacttctgtgcaatgacagttgtacctgggtagccgtttaccatgtcacggatctgtacgaacacgcggtcactgaacagatcaacctgcttgaagaacagatcgatcgaggtgatgaacatgtcgttgtctacaatgaacgcctgtgcgataggatcaccacacgcacctgccgttccaccaccagcaatacactggcagatttcacgatagttggtagggtgatacttcttctgatggttaagacatgctggatctggagcaggcggtgctggtgctggctcaggagcagcacgtgcaggattgactgtctcaggaatgacgattgtcgaaacgacattcagtgtgacgttctgtttcgtgacgttgacaccgccagcgaaataggctgccttagcactggtagtctgcatgtccgggtcgccagtgaggcctgggtcgtccgaaagaacaaactccttctcaccggtgaagaatcgaccgcctgggattttgaactcaccacggagctcaccgttagcgtcagtgataagaggcgaaccaaactcaacaagctgcgaggcggttccagcattagcagcgctaagctggaaaccaatgtctcggcagaactccgaaacgggctgaccgtcgaagaacgcatagacacgcgtgtttggcttcatctttgtagcataaaactcaacgcttcggctacggatgtaagggacgatctggacgtccttgactacgtcgcccagatcgtatttgtcggttctcgattctacagttgccatttctagccttaattagttagcctgggtgaagacatttaggttgcgccacggcgaaccaccacgtccaccaccgcctgtgactggtttagtctctgtcttatttaggacagtagtattgaggtcgacgtgcgtaccccagtcaacagccaggaccttctcttcaacaactgggtttggagcaggatttggagtctgttcaacaatggtcttgatcgcttcaacattagcatcgatgttggtgatgagctgaggaagcatcgtagtatcagaccaggtgtcgttgtttggcgacattgccatctgaccttcctgattgtactgcaggtaagggttgacactcagatgcttagtagcatatggctgctcaactgcaacgctctcagtgaacggtaggtgcgccatgttgcctgacagctggaagcctgacgacttagctgcgttgaacacgagcttacggttcatcaacttgaagcttggacgcagctgggccttggtacggtcagcagctgccttgaactccgtgttggtgagatcagctgcctggaagtcagagaagttgtctgcaatcaaaccattcttgaatcggtcaaggccattagcgtccttgatggacatgtcttgtgccgacttctcgagaagagtcagagtggtgtaatactcaacgttctcgattctcttctcgagcgaaccaatatcacgcatcgtatagcgacggttctcaatgaacttggttcggatgtcgttcaacgagtaggtgtaaggcgacagccagatctcgtagagagccattgcattgtcgtcagtcttcggtggacgtggatcatccgaaggctcacccttcttaacgtagatgtaaccatccttgttgatctggagaaggtcagtacgtgccaggtagtattcgatatcaaagatagcggtactatcgttggcaggcagaacagcatttactgggtttgttccaaggatatctggacggaagtcgatggaagcagacagaggataaacaacaccagtcgtagcagtgtatccaccaagagtctcatatgtcacccctgagtcgtcagcgttgagggctggagcataggagtcaacagtgaagaagccctgcgaaccgctgtgctcgaagtaatcgaagttgattgcaaggcggtacgagttgttcgccgagaagcttgcagccttcgtacgaaccagcttggactcgcggtatgcggtgtcagtgatgttaggattgatcttgtattcgtcagtgatgtctgcaactggagtttctggcgagccttcgacgaacagcttgacgctcttcagacgatacgcgtcagtcacaccaaggacgatttctgcaccaatagtagcatcaggtggcgtgtttgtcgtaacagttagattctgaggcgttttcgtgcgctctgtctggtttgttttcaacacgtcaatgatcacatataccgatgcaccggcggcacctgaaccgagcgctacggtaatgctagttgggctgaacgtggttagcggacctgggactacggaggttgtcacaccaccagcaacataccatgcgagcatggtcgaaccagcgttgtcgaaatattcgttagccgaagtcgtgaaggttaccgaacccgaaccgtccgcaacaccattgagctttctgcgaacgacaacattcattgcaccgttgagcgggtcatcggaggatcgaagtgacttgacgttctgacgatcgatcttgtagatcagaggagtctgattcgcattgtagagttcaacagagcctgtgacagaatcaacaaccgcgttggtgtagaagccagagcttgcaaccacaaaggagcgagcatcagacagcttcttgcctgggttcagagcaatgtcatagacatagtaacggtatgtagcgttcttggtagacaggttacctgagacataagcagcatcgctgatcttcagggtaccaattggtgcacctgcggcagcattacctgtggttggctgatcgtagatgacgacagttgcatctgtcatcatacctgcgttgtttgcaccagcccagatacctgcacccttcggaacgccgaggatgtagctgcgtccatcgaagtgcttaacgaacgaagacatcttgttcgtatcacgtgccttcttgaacacgacaggggtatcggagattgtctctacacggtaacccttgacatatgcaacggatggagtgacaactgagaccagcgagtcttcatcaccgtcaacagaccagccaagcgagtcggttgcagatgatttcttagcattgaagaaggagaccttgaacggacggatggtgtaatcaccatttgtctcataggtacgcttcgcgatggtatccatcaggtcagcatactcagagtcagtcttcatgaactcaacggtcatgccagggccaaggcggcacagcgggatgaagttttcaccatcctcaaagttgtagctacgcttggtcaatacgagcttagcctggtaacgatcggcacctggagcagtgctgtttggataacccagcgatgggtcaagcagcgagctgtcttcctgataggtgacgatgttctgaacaaagtccagaccaatcttgcaaggaacaaagttgacgatgtctccgccagcattcttctcgaggtacttgaccacgatgatgtcttggcgagtagtatcgaggaacattccctcgaagtagaagataccttcgtctacagtgaagaactgaccccagcctgttggaggcagagtgtcgctcagaccggaacctgggcaagatgggcagcgaacagttacagtaccaacctcaacgctgttcgagtcgaggattcggatgttctcacccgggatgaatactgaggtttcgccgtcaactgcggtacctgtgtagacgacataaagagttgccggatcgtcgccttcgacgtcaacaccacgaacaagagttgcggtgatgcctgaggtctcaccaagaaggcgagtgttctcaggataggtagacacaacaggcgtaccaatcagtcggacataagccttcgactgcaaggaggtacgcgcattgctgaccttcgaaccattcttgaagatatggttggcgaaggattcaatctgatgttggaagatactctgtacctgattcagttctcgagcctgaacaggacgcccaggctgatacaggaccttcatgaagtttttcttcggctcgaaatcgtcgaagtatggagcacgatttaggtcaagcttggccattggttaccttaaagcgaaattgagatcttgatcacttcttcctgcgaggaagtgtgttcgatagctacgatgttgttcatgtacagaacaaaaccgctgcccttgagatatttagcctgcgatcctgaaacaaaatctggatgcgacggtccgatgtaggcgagtgcgttctttgtcgttccgcgaacgcccgaaaccagagttacctgacggaacgaaccgtcggtatctgtaggctcagttgggatatatccagacaggcttgcagacagacgagccgaaatgagaacagatgcgatgccaagctcagtatcaagattggaaccgtgaccgcccggaggagataggttagccttagcaacgccaccagatgcacctgggatgatgaacgccttagcccaggtgtaaccgctaccagcctcagtgatgttcaccgctgtgatgatgcccgaggaaacaacgacagttgcttcagcacctgtaccgtcaccgatgatcacaaccgatgccgaagtgtaagccgaacctggagagctgaccgtcagtgtatcaaccttgcctgcagcaagtgtcagagcaagagtagcacctgtacctggagtaccgtccttataggcgatagcataggcttcggtatagttagaaccgccggcggtagcatacagaccggtcagcgtcttagatgcacctgaagttgtcgaacgtgctgcaccagatgcgccagtaccgttaccctgaacaacgacacgaatcgtgtctgtagatgcaaacggcgtcgaagtcgaaaccatatcagtgaaggacgagatctctccctgaacagtggtcacgttgacttcggttggagcaggaacaaattcggttgtgccgaaagtgaacatctcaggacctgagaccgaaccgacatacttccaaatgtagccatccgcagtctcgatcagagaggtgcttgttccagttggtgcatctgtcgatgctacgccattgttgttatcgaggcacttgtagacataggtgccgccaacgatagcataattcggagtggaataggtaaccacgtccggatcatactgagaatagattgtgccagttgtccaggtgttgttcttcagacccagacggaggttggacgagtcgatcttgataagagcagtgaggtcatcaagtgcctcattctgtcctgtcagagatgtatctggtgcgtccggagtagatgggttcgcccattctgtctgcttaccaacaccgaggtagatgtttgagatgacgtcgccatcttgaacattgtctgcaccaagtgcaagccagcgcaccgtgccgtcatagacagcgccagtggtattggatggaccgttaccggcacctgtgacaccttcctgcatacagatataacggttgttgccgttggatacctgtgcgcctagcgagtaggaagtcgaaggagttctagctgatggacgaacagacttcatagcctcgtacaagctggagatcacatatggtttgatagcaggcgtgaagctgtatgccatttcttagatcctcaatcaattaggattggttcaaataggttggtgccgatttcgtcaccggtgtctgttacgagtgtgattgtctcaaacgattcatactcagacacaaacgtcaggtttagaactgccggatacacgattggagtttcggtaccaatcgcaggagttccacttgtgatatttaagccaaggttagaaacaatctcatatgagcttgagcgaatgaagccaactggatgcagatagtctgcaacaaagctgtcgtagaggctcgaagagatagggctcacaatggtgtaggagaactgctgaacacgatcagagtcaatcagtgttgagctctcagccaggaagccttttcggtcagtccagtcacgagtttcccaacggctgactgccttagcggtcatggtgccgcccgaaccttcagagcttacgatagtgatatcggtctcatcgaagtctacaaacgggttctccattttgacagtttggatcgcgcccacgttaccacccgacgccttaaggctcgctgggacagcactctgagcataaagattaggaagtgttgcgtagttgtagccttcattgatgatcctgtaacccgtgattccaccctggtcgttcacctgagtcacttcggctgagaagccaaagccatcgtcatcggaacgtgctacgatcaggtcgcctacagagtagttagcgcctgttgcgataatctgaatgctactcacgccacccttacgagtgctctcgatgtaagcattgccgttgagcttagcgccagtgatttgaacaacctcacctgccttgtagcctgaacctggagtgccgacttcaattgctagaacaggcttgacaaactctgtgatagcaaaatcgccagacacaatggtgacagcttcgccaacaagaaactcaaatgttggacggagaatctcgattcggaaatacggtgtacccgaaccatggacgatctgaatgttctcaattgacgccttgaccttagtggtcaaacccgtcaacgtaccgccattctcgcgcacatgaagtacgagatcctggaagtcaagcatgttgatgttgttcgctgaggtgaagatgaaatgacgttcaccatactcagcataggatggaaccaacatctgttcacgtgggtagcgaatttcgacgtcggcgttgaaaagcatacggaacaggaatcggaacgatgcctcagtgcctcggctcagatagaagtcctgcaaaagatgaatcagcaggttcttatctacagctaggttctgccctgaaacaaatccaaggtctgtgagcatcgcatcaatgtacggctcgaccttgagcgaaggctccatgttttccttccaggcattaatgatgcccaagaagttgtcgtcctgttccatccaggccagatagtctcgcacatattgtacgaaatttggatagttctcacgcacaaactctgggagcttatgcgtgagtaccggaattagtgtgctcatccagcggctaccttagtggtttcgatacgaacgatgttgttcaagttggtgttgatgtctggcaccgcaggaactgcacggaactccagaacaccagatgtgcttgtctcatagcctgaaaccttagcagcctgaggcagtgcataggtaacgacacctgaaacataatcaaccgtgcctgagttggcgacgatcactgagctatcagcaacacgaaccaacttaagaacgcctgcggcgtcatcaatcagcttgacagtctcagtaccataggtgatcacacctgattcgattgttcccttgactagacggttaccaaacacaaccttgttcgaagcagtcgagttgtgcaggtgctggtggtccttagataggatctttgaggaataaatcgaaacaatggcaggctcaccctgacgaatgtaagacaggagatcgacgtcggaaaggatgctatcaaacttggacaggtaggtctcgttgtattccttgacacgatcaagaatcaggttgaacagttcaggctgcgaacgagtagtcttacggagatcaagcttagcagtaatcgagaggtcaatgttgatgaagtctgggtcaacgaacactacgtccattccgaccacaccatacttcttcacaatgtcctgacgaatctgtgtgcggctaagtgcagtcaacttgtccgagttcttaggcttgatcgagacatagactttaccgtaatctcggatcacgttctcttcaccgccccagacgttgagtgaatcaacattgcggaacttgtcaagcaggatgctacggtagtcagacgagatgacgattctgttctgacgcttgttggcgttcggaatagcgaatcgaaggtcctcaatcgactgaggttccataccaccagccgaaatcgagttagtcgttacagtcgagactgtgttctggaagtcattctggaatgtgaatacctttgcgccgttaccggtctcaccgtttgtgctgatgtagctcagttcaacagcgttgccgttttcaggctgaacaccgaacacgccattaccaaagaagatctggtagtaaccgttctcatctgtcgagacaaagaataccttagatgtcggatcaaggtcaagcacatctgatgcgatcgtgtactcatcgtagactgtcgacgatgcattttccttcacgcgcacgcggaacgtatctacgtcagccatttcatccttgagaatgaaacgctggttctggacactcgtgtcaactacaaagttccaagagcggaactgaccttcatagatgcgcagaggtgctgaggtataggttgcagtcgagcctgtaaccgaacggttgtagatagtcgtaccgtcaaggacagtaaagatacgctgatcttgtgtgtcgtttgttgccttgaaagtcgtaccacgttcaataggatagtttcggcttagtggctcgttgtctgtaccaactgtgagcgtaagaacaacctcagcctttgcagactgcttacccttcgggacataggaggtcttcttagcatggcttagcattgcctgacgagtgtgcgccgagtcaatgaatgcctcatcaaggagcatcttgacgaagaagccgatgtagtgagtttggtaagacgcgacgttgagcagcgtgctgataccggatgcttcaaagttgaagtcggaatagcgatcgtttcccttcaagaactccttgaagttagtcttgatgtcttcgaattgaagagactggacaggcaagtttttcatcggattctctcgacaatcaggttaaacgagtcgatggtattgatcgacttgatcttataggttacggtaatgtcaaagccatctttgttcttaggcgcgacgatatcaatcgactgaacctcgatgcgaggctcaaccttggtcattagccatcggatatctgtctcgagagccgcgcgtgtgagctgcgtgttctgctcgaacagatagtgcttcaggctagacttgattgagttgttgaatggaatgtcataggcattcaactgaaaggcgtgccttacagctcgtttgattgcctcttgatttaccttaggcatgaggtcacccgtatgtggattcgggatcaggttcaagtctaggtcggaaaagattttgttctcagccattagcctgccaatactgtcattgcgcctgtcatcaagatcgaaccgcagttggcagaatcaccaacacgcataagcggaagaccgttgacaaagacggtggaggaacccatcattgcgaagctcggatggcagtgatcgcagcagtgtggctggattgcatcactgactctgtgagcaggcaaaccttcgatgaacaccgtaggtgaaccttgtaagaccttctggggtggatagcatccatgtcccatggtcatatctgacattcggcaagttggtagtcccatatcttgaatatttacctacagccctttggaccgttgttaagatcgcaatagaattgtgtcgccattgctttgagtgcatccttcaagcaataggtgatcacttcttgcgttgtgatggttggaagtagagaaggcttctcaggctcctctggacaagggcaaagcgtgtcgggtagcttaggagtcggaatgaacggatcgactactgggcacggttcgcatagctcaggtaatgttgacactgaacgtttctcctccgtagccaattggtgtggttggtagcgactggttcatgtagtcacgccattgagccatcaacactgcaaggttgtttggatccattgtaggatcaagacgaatctcagcaagttggagatagttctgatagttggatgctacagcgtactcaagcgcctcattagggttggtctctcgatagtttgtgatgatcttgaaaacttgtgagtctctcaaatcatctcggaacttctcgagatatgggttggtgaagacagtgtccttgttgaggtcataccaggtgacgatgtcgtttggttcaatgcctgcaagctctacagggattgcgatcagttcaacctgattggcaaccgttgagttctggcatggttcacagacagcatcaattggttgaggaatgaattgcgtttcctccatcttagagcaaggcgcgcactcgacttcaagaggcttcggtggctctacgacacggacataatccactctttggaatgggctctgctccatgaagttgtctaggtcaaatgtccagttgttgtggatcttgacacagaaccaatcttcatcgaatgcggtttccttcaggccatcaacccataccttcaccttgaagcgccactgacgaccccaaggccatgacgttccatcgttgtcggtgaaataccagttcacagcaggtgcaggcgaatcctcaaggcagtcgaggttaggcaaaagacctgtgatggtaccttggaaatccatctggagacccggaggaagctcgccttcgaggacctcgaaatacagagcctctttacactctctaggagggcgcggcggatcagacacgatgcatgagtactcttcccctgcgaacatatcaacaacaagattcgctgtctgcgaatagcctgtgaacgatgcagtgaacgaacctgattgtggagttgcagtgccagggcgaagacagatgatgtaatcgccaattggaaaatcaatggtaacgctgacaaacgcagatgtgatagacgccgaaccaattggtgttgcagttgcaccgttccaactgaacaccgtcatctgtgtgttccatgaatttcctgcaaggttgaatgcaaattgaacagactggaactgaggcgaacggagcctaaacagcttgttagccgtcgacgtcacgctgaaaggcatgacagtgttagggaagatctcttgtagagatccaatccctcccattcctgcaattgattcaagacatgtagccatttgtaaagttttcttttattactggttacttactaaagaaatcttagaagcatctagccttgattgagtgagtgaagaagtcaagctcaaccggaacaggattgaacttgtcccaatcagggtcaccattctcgttcgaagggacatactcgttgtccaggcaacctacttcaaggaactcaacgtcgtagtctgttgacaggttgaccgaaacaaactcacctgctgcgccgtagatgtccgcttcctcgaacttagcaccaaccatctcgccaccgaataggctgatcgagaattctggattcgatacacgtacatatggaccttcccagaagttgatgatccaagcatccgcaatggtgacgatcgcatcgaggttttcacctgttggcattggaacctggaactggacattgttttgaatgtcaaggtcaacaaatccgccgtcaaagatgagagttgagtcattgcagagcgagtcggttgcaacaagttcaacattgacgtgatcaccatctggaaggaagttaccctcacacaggttgaagtcgtaacggttgtactcgacacgatcaacaattgcgcctgagccttcatagaagttgaacgtcaggtattcaggatcaaccgtgtcgaagcgctcaccactgtagacgttgaggctgaaacgaggcagagtagacagttcagcagtgaagacagtcttgtcaccgtcgtaacgctcatctggtgctggacctgcggtcagttcgattcgtgccgggttgtccttaattgggcagcaagcggtgttgttgagatcgacccccatgaaaccgaggatgtcatagttgaacgagtgaccatccttgatctcatttggatacagcagtacctgtggcagcgtagtgaacgacgtgatgatgttcgcgccgtcatagatgccaagagtaccaatgccctgagaaggacgagtatccaggatagcggatacgttctcgccgccataaccatccataggcatggtggtctcagtcgagaatgtaacctcgaccgatgcaccatcatagatatagtagttctcgagtgtatcaagaccaaccgaaaccgatgcaccatcgaacataccgaccgtgccaatctgcagagcagttgacagatcaaacgatgccgatgcgccttccgccatcgcaaacaggaggtctgcagatgggttgatcttgatatcaaagtcaaacacaccgccatcgtatgcaacaggctgcaggacggaagttgtgctgagggccaggtcaaccgaaccaccgtcatagacgttgatcgggaatgttacgaccgggcgagtatcaagaactgtggagaggtatgcaccatcctcgaagttgttgattggcaggattgtcgaagtggacagatcaagcgcaaccgatgcaccatcgaagaagctagctgcgatgttgaagttagtcgcaggataggttgtcagcagaccatcggtacagccttgcatgttcgcaaggtcgatgtacgatgctgggttggcgtagttacgatagtaccaaactggaacaatcgtgtttggccatgcaagattcgtgttctgtgcggaaagaagctgttcgccgtagtaaatctcaaggcgaatgcttgaaccgtttttggtgaagcgagcacggacacgcgcgccatttgcataaaggtcgagaccttcaggcttctcaaatggctgcaggtagattgtatcgttaccaattcgcgcaacaacctggacagtctggcgaccagtgtctcttggcagctggaatttcagccaaggcgcggtgttgatgttgtacggtgtagcgtattcccagtagcccgttgcagtcgtaatgctcgagtgcgggcggttgaagaacacgccgaactcgaggaatgcatctgtgctatcgttatcgtaccatggaccgcttagagtctgtgtccatgaatactcaaatgaatcttgtcccgatgtatcaacaagcggagtaccgaccgaagaacctacggttgggtcaccactgttctgaaggcgaacagagttgagtgttgggtttggagccgcgtttccgctcgaaccaatgttgacaaggccagtgacgttctggcaaccctgaccaccgatccaggtcgcaccatcatagaagttgagaggcagaccaacgcgggttgtcagctcaacaggagcaacggaagcaccgtcgaagaagttgagcggcaaatagccgtcatacatcttgacctggagttcgccaccttcacgcgcttcgatgaagccttcaaagtcagagtagcgaatacctgaggacgcgcatcggaactcaattgggatgcggttacctggatatgcctcagcgatgttatcgaacgtaatcgggatgcgattcgttgcaccctgatatgtccagttagaacagatcgaagggaatagctgagggataccgaagttgacagtagacgcgataccttcaggctttacagcacgttgcacacgcgcattacccattgcactgtcaacgaatgcaataggagcgattgtctgagagtcagcaggtgggcgccatagagcatggatgacgccatttgtaggattgaagtactcgtccttaccagcccatgaaccgtcaagtgtccaaattggcggagcatactcgtaccaatgcaggacgtagttattaccaaattgggttgagacccaacctgaaggtaggatgttctgctcggggatgatcttagcatcaccgaaggtgagcgtcgattcaatacctagaggagagatgacgatttgttcggaccacgatgcaccgaccgcagtgactggagcagagtaagacttagctccgaaccaggttgtgtctagcttcccgccagttgggcggatgtattttgagccaggcttagtctgtacaacgccaaagtcagattggtcaagacctgcaggcttgatgaattgctgttggacaattacaggaacgctgacaacggtctggcgatcaatgcctgcgccaatgtatgtcttgtctccccacgaaggtgagactacatgcgcaggctgtccatagacaggcttaccgttccatgaaacctgaaggaattgacccgacaagtgtcctgcaaaactaaaggttgcatcattactaatctcgataccaaagatagtactttccgggcttacaatgtccagagttcccacaggtttggtgtgagttagattagacgcaatgaaatcaagtggcatcgctgctacctgcggcgtcgtttagattttcagatagcgcgttcaacacagataagatatcagccctatagactgagatatttaaccgtgttttcagatagtgaaaggcgccgtcggggcagggaaacttgcaacaccttggtatcgtgcaatgttgctcactcttacttcgccgactcttccattgatgtatcgaacgacgtttgcaactcgccctgttcctacgtaggtattggcagtagtaacaggtgccatccagtagccagctgtaagagtcccagacgcaacctgggttccatttaggtagagatatgtattagttccaaatctttcaaaagcaatgtgataccaagtattaacttggagcaagtttcctgctgaggaaaggcttgatgtggtgacaggagatgcgccaccaccctgacctgcattgacatatccttcgatgccgtttgcagaagttgggccaatctgcaaacggttattgttgtttgcgaggtcaccgatataaaggacacattgcgacgatggctgagaaagtgcgttcatatagaaccatccttcaactgtccaatctccggagccaggcgaaattgcaggatagtatgaaccacccgtggaaccgtcaaagttgatagaattttcacctgcaaacttgccgctagctagtgtatagcctccaagcatgtacgaataagcatttgtgacttcatccctcggttgcaattcgtgatttcgagtgaggaaaattgtgttcacgtccacatcaggatcagctacttggaatggtccacgagaaattggtgtctcgaccagaccaccatcaacccatgcagctgttccgtcagtgaagctagtaaccgatgaaaggttgaggctattggtattcggagtggtgagagcaccatcacctacaaggtaaagagatccgggcgggaacttgtaatcgaactgtcggcttccgccagacccagtcatggtccaggtgatacctttggcgtcgttgatgttgtcgttgaactgtagaagagatgagacgttgttatacgacggatctccatctactcttggataggcagaagcaggtacggtgaaggatgtcttgtatcgagctgcacgagtgaatcggaactcgtcgatccaacctgtcaggccatcgtttgtgtttggcgaataggtgaagttgccaaggcaaacctgcatggtaggtgatgttggaatctgagatccggtataagcaccaacaaggtttccgttcaagaacatgcgaacgccgtcggacgttcttaccaatgcaacatggtaccatgtattgggtgagataggtacagtgactctgggcgcaccagaaccgccaaactcagaatagaacgtcaggttaccttggttgtctcggaagacgttgactcggttacctgcgttgatactgatctcgaaaatgtgaggcgtgacattggaaccatctaagcggaagaatgtctcagccgtccaatctccatttaggttgtagtcggcactctcagcaagtctgagataggaacccaccgaacctgtgaagtatgctgatgaaccaccaaacttagattggtcagtcttgatcactgctccagagttgatccaggttgcacccttttcatcttggaagactgttgcaccatcggtactgtcaaagcgagacagaatctttgtctcattccaaagaggatctaccggaccgtatgtcaggaagtcttgtgtaggtacggtgaaggagttacctgagtagcgagccacacccttagtgattcggatgctatcaaggtaaccttcgaagaagtttgcaagagaaccggtgcccttatctgcaccgatgacgacatcgtatgtgtttggagcgatagtcagattagcttgctgagcgcggatggttccatcaacgtagatgctcagagtgccaccagacattacccatgcaacgtgataccaaacgctcgtggtagtcgcattggtagcggaaaggtattcggttccattgaccatgaagccaaccgcaccacctcgagtgatacatgcaaagccttggttagattcaccaagcttagagatcaaagaggcattgctgttagctgcctttttcatccaacattcaatcgtgaagtcgccgcccgaagcccagttaggttcgacagttcctgaggtacccgcagtagcacaggtataccaatgtcggttaggagtctttggcaggatcttttgtccaacagtataggctgtcgaaggtagccaagtcgaaccgtaatcagaagtcgccacaccaaacacatgagcgccgcgcgccttcaatccatagacagagtaagaaccatctgttgcacttgtggttttccccatgagttcaggcgtcaaaccattcccgtaagagaatagcgagatatctttttggcgtgcgacaccatcgacattgacagtgccattcacggttacaaagtttcttggcattaggctaccgctgcaggagtggtacgtgcatagaacaggtcgttcaggagttcgccattgttggtgatgaactgaacatcatatgcctcagtgtctgaggttggagtgataatggtatagttaccagttgtagcatctgaggttgtctcagcaaccagaagtccgtctgagcggcgatatgcgcgaatcttacgagcagctgggttgttattgacgtctcgaaccgtacctgtgatggtacctgtcttggcattgataacgatgaaggaagtgattgttcctgaagaacttcctgcaactaacgactttggagcagaaaccattggttcttcggcgtaggttgtgccgttgaatctacggaagttgtctgttgtgtaggtgttagagccttgataggtatagatcttattgaacttgctatcatatgctgcccaatacaaatattcgttgctacctgaaggcacttccgtaatcgtgtttgcaacagtatctacttcaaagagataagaaacattagattgtgtgcaggttgtcatcatgaccgaacctggctttgtccagtggtcaaatcccttcacagcaccataaccatactgatatccaccaacataagaagttgtgtgcgagtatctggagtttgtgctgattgttgttcttgttgcaagattaggtgtccactttgtcacaaaaggagtattagccgaaacagacacaagcgttgtcccatcaggtgtccacttgcaggtcgagtagttcagatgagctgatgcagcatcaatataggttccatctctgagatcatagattcggaggaacggagtagtaccgtgagtaattgcgaggttgtatccattaggatgcagagagcaactatagatttcaccgagaccagtctttggaagagtaataaggctattgtctgcccaacggaatgcgttgatataagaagtcgatgatcctacccaaccatagtaatcgttgccacaaaacgcgtcattgatgaaccctgcgtatgctgctgtggcattggtcgaagtcaagcctgttgtagttacagtaaagtaacgatgtacatctacagaagtgttagaatgtgagaagatgcccttagcctgatccggagacagcttgatcaaagaacgatattctgagttgtaaccgttccaggtaatgtcgatcgttggatcgataattggctctagaccctgacgaagcatgaaagctctgccacggtaagggaagactgcatatggctggtaaacgattagatgattcatagacggaagattttgttcgtaccattgtcccaaacgacgttgatgtcaccgctgtttggcgttactggaagaccggatgcaatgtcaatgtaggcgatcagaggagatgtagcttcagtgcctgtgtctttgtagagcacgaccgcctcgatacttgcgcctgagaccgtagggaagacagcgtcagccgcgtcggctgcaccgtcagttgtagtcttggctgtcagagtgatcggtcctgcgacacgtgcacctgagggaatcgaggtaacaaactcatgcgtagccaggttgactgtgtagttgcccgagtcaacgagtagagcacgaatcgtgtctgtgttccaattgattgcgccttcaagaaagcgctgacgtgccttagcgtatagtgagtttgccattgttgtttctctttagttcgtcttatttagacaggatcgatatacacccagacttcgtctgtaccaccgatctggctaccgtccttaccataggtacatctgatcacatcgccttggttgacaggagcagtataggtgaaggtttgaccaacaccgcttacacgtgccttttcgacattgttgatgtacagatagaaaatgtcatatccattctctgaagatgagtacatttcaaatctgaggttcgagtaatacttgtcagcagtccaagacgatgaggtagtttcattgttaccaatcaggtttgatctcagtcttggacgacctgttgtatcgttctctaaaatccaacttccaacaaatctcgagacgatcggtgtctcagctttttcaatgccaccttcagcaaagagacctgaggaatcttgaactttgaaatacagagtttcttcaagaggcgctgtcacttcgactgtcaagaatcgtccatccaaagtgatagatgaccctgtaggtgcaaccgtgtctgagcttagttggtaaggcaacacacctccggttacctcaaagactcgcttgaaaacaggaacagagaacgagttagggaagccaggaccatgcagatacatctgatggtcagtccatgggcgaatcttggaaaggatgatgtcgttatagactccgtcttccttttctcttgcaacgagatcaaccaacagattaggattgagatcgttgatcatgtaggttccgttcacaggactagatacggtgcttgcaaagatctcttttcgaccttcacggaaatgcagctcaattgttcttgatgcaggtgagccatcaaccgtaacaatgcccgggagcatacctgcaatgtaaccaagaccaccaagttcttttgagcgctttcttacctcaccgtctaggaccatgtaatgatctgtcctgtccttccaggtataggttccaatcttcttgaattgtgctgcttcaagcaggattgacattaccagtctccgagaaggatgtagacaccttgggtcgtgttgttcgtaactgcaaattgaataaggtcaggtccggttggattgttcggaagctttccgtagttctcattccatgtcaatgtagaacgaccaaccaaaccgtagagaccacgccacttgccagtgatgttagtctggattgcattctctaccaggtatgccggatagaagatacgctgacctgtgtagactgagaagggatggtgctgatagtaacctgatggccagctacccgccatgtagtgcacccatgccttagagaacttgtctgcgacattgtcctgtgcacgaccaatcgcacatgcaacgtaggagctctgatcatcgatcatgcaaggaccgttcgaggaatagccaccatcatactgacctgctacgaagtagttatgaacaaagctaggaacgaatgtctcataatcaccggcaccgtacatgtatccatagttgacatagctgttcgcagcctgactcgaccatgggcaaacattcaggtagaacgttctctcatcgccgatgaaattccacatgattggattggtgttctgcgaagccgacttaggccaatagatattggcgttggaatagcttggtagcgttccaggaacaccatcagtgccagtagacgcatcgttcatggtcttgtatgctttgaccatcgcatactgccagttagagtcatctactcgcaggtacatgccagtcgaacctgcagcagtcgtagagttgcggaacactgcaacgttgcctgtctcgaactctagcgtccaacccatacctggcttggagccatatccgttgacaagaacagctttcaggactgtgatgaaggcgccaggtgttccgctaagaacaggagcgtcggtatcggtgtagaggtactgggtaactgccattatggaacatcctcataaagagctggtgcaatcggtccatagacacgatagcgaatgtttggatcttgtttgttcatgaccatcaggtcaatcaaagagttgtcatacaatgtcatggagtagtcgcccgaagaggtcgaggattcgatctcacgaagcagggcgcctgttctatggctgaaggcgcgcacagtagcacgatatggattaccttgcagtgtgacattaccttgaatgcgatagatcaacgaatacatgttacgtagacggatctcggcatcatccagcgcataaggatagacacctaccgcagacatatagccagtggtatttagactgcctggagcagcgcccatcaagtagacctgacctggacctggagtagacagactatgaacaggcgcagtcaccgaaccgtgcttgataccgtcgatccagagggtgacagtgctccccttacgaactgctgcaacgtggtggaatcgaccatcattgaaattgaaaggctgaccattgtctcgattcagcaaagaggaaacaaagtattcctgactcaccgatagctggacatgtcctggcacgttggtgttgttacggcgattcacttcaatcagaacaccgccatgagggtagtcgtcgcgctgacaggagaatagaactgatctgtccgtgttcgagaactgcatccaaaggtcaaccgtccagtcgccattgaagttgaaaactggcgtataggtcgagaggttcgttagcctatgcgcagcagccataccaccattgtggaagtagacagatgagccaccaagaataggacttggagcagtctgctgtcgtgctactcgtgtcacgccacctagatacgttccgtcattgtagcctaccaaatccttcatcacgaagactgccggatcttccacgtctgtcattggccagtaagccgatgcctgagcttgcactgcgatgttgtcatacgacttagattttcgatacaagcgacagatttcgtcctgggtcaacgctttgttgaggatgaacatctgatcgagttgcaggtcgctcgtctgacggtcttcgaagtatgatgaagagttgattacgccagcgatctcgattggcgtagtagttgtgcttgatgggaaagtgccagccgtagttgtcgaatagctgccatacagatggccgttgacgtacaggtaggcctcgttgaggtagacgtcaggattgatttccgtgatcttccaagtgcagacaatgaagttcttcttgctatagaaccaatcaggcacaacccagacaatctcaccgccaccagggtaaccgaaacgaatctcttcggcagctgaccaatagtcacggaagtagacgtcgaacgacccagccttacggatgaagcgcttgttgagtgtctgagtataggtgttgccaaggattcgttcctgatcgcgccacttgtcttccttctctgccttgttgacaaagaagccaacagtgtaggaacctcgctcttcagtcagagcaagatgagactggtgctgcacttcaacgaaagattttggccaacgagtaggcgcaagcggctgatagccataccaaccgaatgatgtgctacgttgatctgtctgctcaatgtcaatcagagaagggatacccatgcgataggctgggtagagttctgactcattgtgcaacatgatgttggagttgaaccccgactcgtcaatgaagacctgcgggattgccgtgagcgttctgctgttcggatcgtacgcatctccatcgaaggtaagaaacatcttcggcgcgtgcgaaattactgtctgtttaaagcctgccattacaaagtccttggaggtacacgaatatttaccacggttgttctttcgtaggtgaactgtagcattgtgaacatgaacagaacacgccaagaaaagattgagtacctcgccgacgctctgctcgaagcccaaggcaaagaccagtgcgatttttctgaagaagcgaaagctattctcgacgagatctttccaccactgcccaaggtagcgtacgacaaggcgtacgaccgctacttcattccgttcaccctgaccggcgccgaagtccagaccaagggtcacggcagttcgttccgcattcataacggtgaagaccgtcgtctttctttccaggactacggcggtgagcacgaatttctgaccaagctggcgcgtcagatccgcctggagtacggcgaatgatcctggcaaagtgggcgctcgttctggtgatgtctacctcctgttacggtagcggttgtgctccaggcatcactgtcacctcgatcccggtagagtcgaaagaactctgccttcagcaagccaactacctggcagcagaagcacgaaaggtaactctggataacgctttcagtcagactacgacaaaggcaatgtgcatccaggtagcaagatgaacttcgtgacatatcagctggcgatggcagtgagaagtgctgtgttcgccagtctgatgaacgcatggaatgatcgtgacgacgaggcgaaagccaatcgtcatttcaagcaagcagaccatctcgattccaaattcaagacccaacacggtcaacattatgaggcttacattgaacgctatgaagaattcgaacgcaaaaggcttcacgctgattgaactgatgatcgttgttgcgatcattgccatcctggcttccatcgctgtcccagcattcaagaagtggagcggcggggagtcgatcacttcgagtccggcagctgaggtctcgtatgaggctcgctgcattgacggtcagaagtatgtcgtgtctgccgaaggcgcggtgctgatgaaggactccaacggcaacgtgatcacctgccaatgagtgagatcattcggatcatggaatcggcaaagaaatttgccgaggcaaacctggctgagggtgctcatgagctgaccaggatgtctgaaaccggcatcctgaaatcgaagggcgtggttcgcgagtgtgcgtccatgctcaacctgattccgggaatcgagtcactcaacctcgcgcagacacttttccgcacggctgccctcgaacgcgctgccaaagactttaaggaacgctatgaccgctcttaacaaggaagcagtcgacgccgtgatttctctgcgtcacattgcggatgacgctgcaaaggctgtcatcaaagaactcagcaacaaagatattcctttcgaagatcgctgggctgtctacaagcgcctctgcagggaagacatcatcttcgagttcgatgactatggctgtggcgaactgcacatgctcgtaaaggtcgaagatggcgagtgtgaagatggtctgcatgccctaggctacgaacgctatcaggctatcgaatgggttgatctctacatccagatttctggcaacaaggaagagtacaccgaagagagcttcaacgcatggcgtgagagcattcttcagaacccttccaagggcctcaactacgactggtaaggaaagacaatgaaatacggctcctacgagcatgtaccgctcgacgatatgatcggtcttacgatcgccagtgtcgaacagtccagcgatcagatcgactttcacaccacctgtggaaagcatttcaggatgctccatttccaggactgctgcgaaagcgtctatgtcgatgccattgatggtgaccttcaggggctcattggtggagtgattcgttcggctgaaatgaacaccaattcaggtgagagccgctacgactcggtcacttggaccttctaccgcatccgaactgagcgcgaattcgttcacatcacctggcgcggttcctccaacggctactactccgagcgtgtgagcttcgttcgtttgttgaacaaggaagagcgtactcagcgatacaacgagcgaggttggtaatggctactcgtgaatttgaagcagaacacatctacgaacgctcagtcaaggccatcgaaggtgtccctgttcgtatcgaagaacaatgggttgaggactgcaaagaaagctacgatcgtcagaccaggtattacgaacaactcaacaagcgactcttcactcggctgggttggcgtaaggttgtagttcagcgacccttcgaccagtatgtccaggaaagtaaggaagaggaagattactggggctacaactcgtatgacatccttgtctcccgatacaacgatgatctctacgaactccggcgtattcggaacctcgcggaagcaaacgctgcagcaggcaagactgtccgactgagcgataaggacttccagactatccacttctacgagaaggctgcgccatgaagttcaaccgatactggatcagtggtcgtggcgggcatggttacgaaaagtggaagtatttcgaaggtgacttcaacggagacatcgaagacgcctggtacgaaattctccatagcagggagacctgggcgatccactgtgagtgcagctacgccgtcgaactcgatgtgattcctccgaaggaattcgtcggaaacatgatcgccaataccgccgaggctctgttgaggaaacagcagttcctcgaagaactcaagacctactatcaaggaatggaatgagcaagaacatcaagcccggctatcaggttcacgtaacgtcgtgggaaaacgatgccgacaactacaagacagaaattctttctggtctgacgaaagatgaagcacagttctacgttctgctcgcgacagctttcgaatctcgctacaagaagcgtccagccggtctgccgtataaggtaagcggcaacgacgaaaacaagacggttgaactgctcaacctgtggctgtatgctgctgaaaagcatccggaggtagctacgaaactttggggcgatgaagatcctctgccgacagtagaacagatcgagctgtatgacgaacagctggcgctccattataatgatccacgtaggacggatgagaagtacgcaaacctagattctgcatctaggttcgtagatttcttcagctctcttatgcaggagttgctcgcagacccaagcgaagtttattgggacttcaagaacttcttccgagtgtgtgatgaagtaaaggtctattacgtacctggcgccattgaaaacgtaaccaaccaattcattgacaaagaaggaaatctgatctgatgtttattctcattggtgcaggaattttggcactcctggcagcagctgttatcttctgggtgctgaatctgcgtgtcgtcgttccggcgaatgaagtgcatacgctccagcgttcgaagtctcagacctcgtacggtaaggaccaggatggtggcaacacttactacaactggccttcctggattcctctgctgggtctgacacgcatctctctgcctgtgtcggtgttcgacctgaacctgagctcctacgaggcatacgacaaggaccgtgttccgttcaacgtcgatgcaacgagcttcttccgaatcgccgattccaacgtcgccgcgcagcgagtgtcgagcttcgatgaactgaaggaacagttgactgctgttctgcagggtgccattcgtaccatcctggcaagccacgacatcgacacgatcatggtggaccgcgctaccttcggtgagcagttcactaaggaagtcagcgagcagctgaagaactggggcgtcgagccggtcaagaacatcgagctgatggacatccgtgactcgaagggttcgaacgtgatcgccaacattatggccaagcgcacgtcggcaattgaacgtgactcgcgaatcgaagttgctgagaacacccagctggcaaagactgcggaaattgcagcagcccagacggtccagctgcgtgatcaggaagcccaacaggctatcggtcagcgaacggctgagaaggaaaaggcagtcggcatcgcgaaggaaaattcgcagcaggaagtgctgacggctcagcgtgaaacgactgtgcgccagatggaagtccgcgaagttgaggcaactcgtgcttcggagattcagcgtaaggtcgccgtggtcaaggcgaacgaggtcaaggacgtcgcaatcgtcgaagcggaaggtcagcgtcagcaggaagtgatcaacgcagaagcacataagcagcgcacgacactggtcgcagagggtaacctggctgctcagaagctgaacgcggaaggtatccaggctgagggtacggcaaaggcagaagctgagaaggcgatgcagctggcaccggtgcaggcacagatcaccctggctaaggaaattggtgagaaccagggttaccagaagtacctgatcgatctccgtcaggtcgaggccagcgagaagatcggtgtcgagggtgcgaaggctctgcagggtgctgagatcaaggtcatcagcaatgcaggcaacccgaacgaaggcgtgaccaacgtcctggacatgttcggtacgaagggcggtacgaagatcgccggcatgctcgaaggtctggcacagtcggacgtcggcaagcaggtcatcgacaagctgaccggcaagtaagaacctcgtagttggggaaggtggtagccagggcaacctggctattgccgtggcataaggagcaaattatgaacaaagtcacatgggcagtacagacaaaccttgtagcagatcacacggctgaggctgtatggaatgcagcaaaggcattgggttgtcagaccgttgaggcatcggtcattccgttttctctagagttcggcaacgaatcagagtatgagaacatcccggacgacacagtgatcattccctacggctcagtcaagttggcgaggatggccaatgagcggaagtggaaaggcagctgctacgacaacgaacgtttcgacgctatccgatggaatacggaacgtgacgatatgctcaatggcgattgcattcacctgacaatcaaagaactgaatcactatttccgagactgcgccgacgacaagaagtggttcattcgtccggtcaaggatctcaaagccttcaacggtactgtcgcagatacggcagacatccgagactggatgcagagtcctcgttctggttcgtttgagtttggcgaagacacacaggtcatcgtagccgcagtgaagcacatctactgcgagtcgagatggttcattgtcgacggaaaggtgatcgatggttcactgtaccgtttcggcggacgtctcatgtcagaacacttgaacgatcccgacgcctacaaacacgctcaggctctcgcagataagtggttacctcatccttgctgtgttatggacgtcgccgatacagaggacggaatgaaggtgatcgaattcaacactttcaactgcgcaggtttctacgaccaccgcattgataagatcgtaaccgcaatgaccgaatgggcagagaagctatgagctacgtaatcgtcgaacactatcgagtgggttgtaacatcgtctctgtacagggtccatttgagacaaaggaagaagcagttgcagaggaaaggcgcctcaatgcagctgagatggaacagagacccatgctctattactacaccgtcaagccactagtcaaggaattggtagagaggacccgtggctctggggtcgatgaaacgggtccggagtggtcatgagctttcaatatgtcgtcatcgaaagaaacaggaacaaccctgagttgatcaccaatgtcatgggaccatttcctaagaaggaagcgttcgaggtcaaagaagatctgactgagtttcctagtccctggtactacaccgtatctctcctcaatcctggtcctcgaaaataaaggttgcaccgtagaaagaactcctttacagtttgattgcctcaatcggaggctgaaataacagaggagtagatcatgtgtgacgaaatggaaacccagaccgtgtccgactccagcgacaagctggcgctctacaacccgactcccttccagcgtgaatggatggagcggaagcaggaagaggcggacttcaagtactggctccatacccgctccaagcccaagcgtgtcgagggcaagctggtcctggcctacatgaccgaggacgggctgcgggctgttcatctgggacgtaccgaagtcctggcagagaccaagtaatacaaggggcccggaggaatccgggctcttttgcggatgaaattcacacagatacgtaagtgtctgatctataagattgtcccaggacacgaaagttctatataatgacggtacggacaaacagtagggcaaccagaaatgaagaccgccacgcaccgattcatcaagtctgaaaaggtcaagttcaaagtcggtaaggacttcctcggaaaggttcagtacacggtcaagttcaaggatggctctactacgacgatgtccgaaaagaatttcaccgaaacgttcgtggagaacaagtgatgagcggttctaacttctactcgaggctcggcaacatccagaaggtgtccggagtcaagttgaacatcgacactggcgaccggatgacgttcaaacccgagcaccgtgggtttgtcatcatccgcatcaagtcgaacaatgtccttctcgcatacgacaagacgcagaaggacgctttggcaaaggtcgaggcactgttcaaaaatggtcgtctcgtcgaactgtccaagctgccgaaacaggcgctggtgcaggccactcctccgccgtgtgcagtctaaggagaattgacatgaaggttgaactgttcgcaaacactagcgggcgcggacactggtcatccgcaaagaaggaagtcttgatcaacgcgatcaagatcgatcgcgcatactcctacgacggcgacgaggacgtgacgctctacatcgacgcacgtttcgacgccaagacgtggcaggttcgcaacgacggcttcatctacaccgacgagaagttcctgcgcgagttccgtcaggggctgatcgagatgggtcttccgaagaagctggccaacaaggtcgagtacacggaacaggggatgcagggtcggctgtatgtcagtctcgcgttctacggaacgaagaaggacatcccggcgtgggaagagtttatgggtgccaagatcaagctcgaggaatgctgatcctcgattcgatgtaaccaatcacaactggagaacagagatgaacgaattgatgagccttctgttggacctggagctgatcgagaagatcgagaagtttggcttcaccctggtcggtgtgttcgatccggaaggcaatgagccggggttcgtgtataccatcggactgacggagcgcggctggcccgaagtgatcatgatcgggaacatccatccgatgatcgccgagcagttcctctccgaaatgatcagcaagtggggcaaggctgaaaaggtgatcatgggcgacaacctggacttgatccagttccaggacaagtcggtgcatccgatccgcgtcatcgacgtgaaccagaacaaggcagaagagaagtatgcctgtcgtgctcggcacctctatccggatcgcgatgtgaagtatgtccaggcgctgatccccgaccgcttcggcaggttccccgatgaaccggaatacgaccagtcgaagcaagcccagcccatcatcgcatcaagtcgaacaatgtccttctcgcatacgacaagacgcagaaggacgctttggcaaaggtcgaggcactgttcaaaaatggtcgtctcgtcgaactgtccaagctgccgaaacaggcgctggtgcaggccactcctccgccgtgtgcagtctaaggagaattgacatgaaggttgaactgttcgcaaacactagcgggcgcggacactggtcatccgcaaagaaggaagtcttgatcaacgcgatcaagatcgatcgcgcatactcctacggtgaagaggagttcggcatgaacgaggacgtgacgctctacatcgacgcacgtttcgacgccaagacgtggcaggttcgcaacgacggcttcatctacaccgacgagaagttcctgcgcgagttccgtcaggggctgatcgagatgggtcttccgaagaagctggccaacaaggtcgagtacacggaacaggggatgcagggtcggctgtatgtcagtctcgcgttctacggaacgaagaaggacatcccggcgtgggaagagtttatgggtgccaagatcaagctcgaggaatgctgatcctcgattcgatgtaaccaatcacaactggagaacagagatgaacgaattgatgagcctgctgttggacctggaactggtcgacaagatcgagaagtatggcttcaccctggtcggtgtgttcgacccggaaggcaatgaaccgggcttcgtgtacaccatcggactgacggagcgcggctggcccgaagtgatcatgatcgggaacatccatccgatgatcgccgagcagttcctctccgaaatgatcgccaactggggcaaggctgaaaaggtgatcatgggcgacaacctggacttgatccagttccaggacaagtcggtgcacccgattcgtgtcatcgacgtgaaccagaacaaggcggaacagaaatacgcctgtcgtgctcggcacctctatccggatcgcgatgtgaagta

SEQ ID NO: 30 - DNA, 198991 bp, Myoviridae bacteriophage
agccacaagacatcgccaataagctgttcatccgtgctcaacaaaaggcaagagaacaatgggtagcatcacacgagcagtcataggacgaaatcagtacggtaatccgataccggaagcatggtataaggcatgtcgtgcatatgaagcaatgtacccggattacatgtgggatgagtttgcagctgccgcaatcgcgaatagctacttcatcgtaccatccgatatagacctatgccatatgggtttgcgcgacctgtgccaacacatgaataaagattcagtaagctgagcaacgattaagataagcgttatttatgaggtagcttttcggcagaattctagcccagaaaaaggttagaaaacaggtggagtggttatgcctgcctttcttgcaatagcgttgcgtgagaacgtttgagagcgaatgactattgtgtcctacgatgatatgacgacagaacgttgcgtctacctgtgagatcccatgagagatgtcgagagcgcttgtgagcgattgtctatgatcggtggcgaatgatagcggatggctgaactatcgtctatgctcacttgcccaaactcacaccacatccattcccgtttgtcaagccttcctccatctacatccactgtcccagcacaattcgtccatctacatccactgtcccagcacaattcgtccatagctgtcaacctacagacatcccgttcggctagcctccatcccataccaatctctcatatcggcacggcacagcctgaggtatactgtacatcatgaaaacacggatgaggcgcctgggtaaacggcatcgggtgaagtggcgtgggaagcgtatgacgtatcacaccggcttctatggacgacgattttcgcccgggctgattgcgccagaccttccttgcattgcacctatgctggattacgaatctaaaatattcacatggacactgatcaatgatgactcacaagacacgacgcttccctaagcaagagatgctggacctcatcgatggtgatgagactctataccagctgatcaatgatgagttgatcgatcatacacgctggtctgtgacgcatgagatcgtcttccgcgataaggcaaccgatcatttcttccgtgcctactacaatgtggctgcaacggagatgcaagatgagtcgccttgggagtatgaggatgaagtggttgcgtcctatgtggttccacgtcaggcgactgtgacgcagtacttccccgttgaggctgattcaaagcatattggagttcccgtgtaatggcatcttatatcgtaactgttccatttcgtggtgaacagacctatttggtagaagcaaatagcgcggctgaggcgaagaggaaagcggcgggtggtgaggacgaagccaatggcgtggagcctcttgactaccatgtgacggcgacctacaatcccactcatgcgcggaaggagtaatcatggatatctacatggcgattgagcgaatcaaggaactgtttggtctttgcttgacacctgacgagcgtgatgagctgtggagcatccttgatgcctatggtgatgatcggtttgaggacggcaaggcgagcgggtggaactgacatgagcgactatccattgacgcgtacccgtcgtgacattgaggacatcctattcggtactgatcaagaagagattgatcttgtctgcgtatggtatgactatcaggagaatgatctgcagcgccacaaggtcctgcatcacgttcgattgcttgatggtacggaaatcgacggtgtgtactacccgaacgcgaacgcatgggcgcggatgaagggtactggacctgagcggttgactgatgatcaagtcggctgggtggcgattacacgtgagcagtggtctatcatggattggtcacataggaagaagccatgaacgtaattgaggtgatggaggtgatcacgcaatacttcgatctcacccctaagcaacgtgagcaaattgaaggctctctgtacgacctgtaccatgctgcctatcaagaaggttacggtgagtgtgaatgggacattcaaggaggagagccgcgatgagtgacatgaccatcatgcgcgcttgggagatcactcgcgaagttgagcctgagtaccatcacaatgactgtagttacaatgtcgccggaatgctgtgcgactgtaacgtcctattcaagcacccagagtatcttgaccatgactgatttgaaatcccgactgtatacgctcatcgaactgatgcgcgttgaggctgacgagatttgtgttgaagaagaacagtcgcatacgccagagaactacggcgggttcatgcatgacatcatctcacgatttgagaaggttgtcaactggcagccaccacgtagtggagcggctgtgatggcgacttacatctatgacggaaaggatgagtacgatgaccgaccatactgatcaagacatcatggagatgatcgtacgggaattccatgcgatcatgacacctgagcagttcctggagtactccgttagcatctcgcgaagcctttgcggaatggtcaacgaatggaaggcgaagtacaaagaagtgacatcaccaattccagttgccttgccatgaagaacaacgaacaagaaatcatggaccgcgcggatcgcatctacaagaacctcattgaggagatcgacaacttgtatcgcattgccgttgacgcaggggcgaatcctcgcgacgtacaaggaccggcgcaccgtgcatgtgggtctgcgcttgccttgcgtcttgacatcaagaatatccacgacaggatctattgacaatgaccgttacccgtgccatcgaagagattcgtgcaatgcaggtactagatgaaacatccctcagtcggattgaggcgatcttgtatgatgttcgacaagccgcctacgatgaaggctggcacgacaactgggactcacgggatacgaattgagatgatctaccttgcactcattgcaattatctgtttcgcgccgctattcgtcatccacggtaaggagaacggatacgtctgggacaacaaggacaacaagtacgagccggtcactcacggcttcggtaacgtgcgcgtcatgcgcatggctccatggggtgtgatggttccgacgatggtgcatcatgactagatccttatttgatccggtcggattgcatggacgccgctacaacaaacacgctgaagtcatattcaatgccgttcaagacgaactggaagaatatttcgtcatgctagtagaaactgattaccacaagtaccacgttctagaagtcatggcagatgctgttatcgacttcgttgaagcgaagcgggcttttcttcgcgaagaggctaacggaaatggctgacaagcgcgcattgtatgaggcatggctgcgtaatgagtacgctcaaggcggaactctcaactacatgctcgcacgtgactcttacggcgagtatctccatacagactcggcactcatgtacgaaggcttcttaggtgctctgaagatgttcccagagtctgtcaaggaggttctggaatggtatgcaagcgaacccgacgtctgggttgcgtggaataaggaaggctgggcggaggaagacgctgcgaaggcatccgggcattacgagttcattggcgaagacagccgtggacacaaccagtacaagcccaacggcgtgcgtgcagaaaacgctctctatgacttgaaggaatggctgggacatgactgagaaacaagaactgttcaccgcacccaaggaccgttggattcagatctacggaaaacgagacatcacccatgtcaccctcaagtggatcgaggcgaagtggaatgcggactggaattgctttgtggaccgtcgcggcaatgtcgtagttggagacgagtggaaatgaccgtttacattgtgacgtatcacatcgactacgaaggcagcagtatcgttgacgtcttccagaatgaagttgatgcatatgccctgtgttcgaagctgagtaagaagaaatcagctggaacttactatgacgtgtcagcatggacggtgcgatgagacatggcattggactacgggacttcttgagaagacaaggacctaatatgacctacattgacgatgacttcttctctggctacgtgccgaaagatctccctcttgacgggcttcctccgttacctccgaagcgcaatctagcgaacccatacggaatgcgaggcgaacccgcttacgggtatgatcgcaatgacctcatccgttatgcgcaacaggcaatcgaacagtacagacgagaacagcaatgacccagtttatgcgcatgtccttctccggtgaccacgcccgatttcatgttcgcgagaagcgccgtggaaagaagatgtgctattggcgcaagtggtggagattcaagaacagtcccgatgcagactacctcgtcggctacaagggaactgtgatcgtggatgaacccgaaatcaaggcaccctatgttccgaccatggacatcgattgggacaacgctatgacagcagctgcaggtcgtcagacaagcaagtcaatgctgacggcagaactcattgaacgcgcgctggaagagaagtgaaagccgctctcattgaaatcggttgggtcggcgcgctcgtcggtacactcgggcttgttccgttaggcgctgcgttagcgatcacgtggtggttctcatggtggtctgtcgcagccctcatcgtcgcagtacttggcggactcgcatctgtcaagttaaatttgatgcttgacgagatcgagtatccatgtcacaatgaggctcctgttacaccttccagcggcgcacctacttactgaggttgacagccggttctggttgtgtatcatgggcgcctaacacaacgagacatgaaaatgctcaacaccaatcaagagatcttcgataccgttgcgcgacacctcctgaaccaaggcaagcgtgccattgcgacttcggaaaccggcgaccgttgccgttatcgcggagataacggactcatgtgcgctgtgggctgcctcatcaccgacgaagcctactcggctgacatcgaaggcaatccggagtgggatccgtttgtgcgcgacgccttgcgtgcgtcgggagtctccctctccggtgacgacatcgactcactcctggagtcgctgcagcacctgcatgacgagacgtccccgcatatgtggcgggctgatttgcgccgtgttgcagaagaccacggtctggaatggaggttctgatcatgaacaacaatcaagagattttcgataccgtcgcacagcatctgctgaggcagaatgcccgttcgcgtcttccgaatgacgaaggctgtgcgtaccgtggtatgagcggtcgtatgtgtgccgttggatgcctgatcaccgacgaagcctacaacgaaggtctggaaggcaaggctgcgaactacccaacggttcgcgaagctttgcagaggtcgggtattgtgttcagagtggatactgcgcagcttctactgcacctgcaatccattcacgactcagagtactcttatgacaagggtttgtgggtggaacggctgcgcgagaccgcgcatgatcacaacctcgagtggaagttctgacatcatgaagaccaaacaagagtttttcgatttcgtcgtcaaccacctgctggaacaggacatgaagtccacgtcgactcagttcggtgtgggtgtgagctgtgcatatcgtggtaacgaagacacgtcttgtgcggtcggttgtctgatttccgatgaagcgtatcacccgaccctcgaaggcaagcgtgccaacaccttcgaagtcgtcgaagctctgcggaactccggacatggtgtagagccttcgaccgtcgacttcctgcaacagctccagttcatccacgatcaggcggatgtcgccgactgggaagaacgactgcgcacgctgggtgatctacacaacttgaagtggaactactgatcatgaaaagtaaccaagagattttcaccaccgtcgctcgacatctcttggatcaaggtgatcgggcaaggcttccatcggggcattgcgcataccgtggtgctgatggaatgacctgtgctgtcggttgtctgatttccgacaaagcctattcggctgacatcgaaggtgaagccgtttccgacaaacgagtgattcgcgcgctggctaatagcggcatcgcgtatcgtacgggtagcggaacgcattggctccttcgtgatctgcaaatcgtgcatgacaagcgtcccgtcgctgactgggaagtttttctgaaggacgttgctcgacaattcgacctcaagtgggaactgtgacgatgaatgaaattcaagaactcctcatcgccgcaaaggcgaagatcgaagacccgaataactgggtgcgtgacgtattgaagttggaacgcgacgggcatatgtgctactgtgctctcggtgcagtcacctcgagtacaaattcggaagtcgacgaagatcgggttctcgcagatgcaatcgaatctctcgagcaggctgcatggatgctcgatccaacgaccggcgcaaacattccgcaattcaacgacaacacccgacactcacacgacgatatccttgcgttgttcgacaaggctatcatgatcgcaggaacctacgtagatgaagaatgatgctctgcaagtactgatcgatgcacgcgaactgatcaacgacgaaaagaagtggacccaaggctcctacgctcgcgacgcggctgggcgctccgtgcaagaaaaagatgagcgcgctgtctgtttctgctccgttggtgcgatctatcgagtcgcaaatattgatccgtgggaagaagaaggttcgatcatgggtgcgtggggtgcgctcgatgccattgcgcagaatgagtacggattcactgcggtctacgtcaatgacaattcgagccacaagcgggttctgaagatgttcgatgacgcaattgagtcgctgcggtcatgatagaaacctgccggtagtccgactaacggaaaaaggacgcgtactactgcagtatctgtgattgtcaacctcggcatatttgagccctgatgtcaacctatctttgaggttgcattggggctttcctttgtgtactataattgcaagaattcaaacacggaaatgcgtgatgaagctgaaagctactgttggcgatgaggttgcgatcatcaatacgaagacgaatcgcctgcagttcgcgaaggacggcgattatgtgcaactcatcggtgggaatgatcacgacaaatgcatcatcctcattgacggatacgagtacacagttcatcgtgagaatcttcccggcaagggaaacgtttacattgaagactgaaaggttgcaaatagttcgaaatcgtgtactataattgcaagaattcaaacacggaatcgccgaaatgcaaaccgccgaacacaacgagaccttgacggaagtgaccttccgcgtgacgaaggatttcctcggctgggagaacgtgacggtgacgttctacgacggttcgacctccacgatgacggcggaacgcttcgcctctgaatacacggtgctctgatcatgaaaaagtacatgctgcgtgacatccgcaatctcgacaacaagcgcgactatcgtgacctcacgctcgaagaggcgtgcctgaagttcggtgacctcatcgacaccgatttgggtatcgtccgcgatcaagctccgactgcgtggaatgactacatgcgcaagatcgatgcagctctgactcgggacggtggtgttgcgaccatcgcgaaggacatcctgatcgcacacgaggtgacggcatgaaactcgagcagtccgcaacctggcaaactcaggcacgtggcgacaacgactcagaataccagatctacgtcgcgaacgccgaagctctcggctggaccatcaaaacttactcggagtggctgaactcatgacttcctattccaacgactacacgaacgaccagctcgccgatacgctggaccgcgcaatcgaacgggtgcgcatcggacatgacgatttcacctgcatcgcgctgctgaccctgcgcttggatggtgaaatctcaccgggagtcgagtatgaagtcgagctcctgatccgggatagcatcgatgatatgtatactttcgagcagtactatcgtcggaagttcctcgaaggcatttctggtgaattcgacagcaccacgcgcgaaacttacaagcgcctgcgcatcgaacacatgacggaactgtcgcagcgcattcgcaacggagaagtgtaatcatggctcgtctcgtcggacttccggaacgcatcgaccagctcatcgtggagtaccagcagaatcatgctggtcagcgcctcggtcagtacgtgtggaacaagtacggcgtcgccggcgttgacggcaagactgactcgatgctcttttacgcgacgtaccaggacgctctcaatctgatcaggaatcgctactatgttggttgaactgaccgagcgcgaactgtaccttgtcgtcgcagctctcgaaaccgagaaaggcgcgatcatcgaacactaccgcatcatggagaattggaccaatgtgcgcccgatgtctcccatgatgaaagctgaactggacgaagtcgtcggacttcgaaacaaactgagggacatcaagtcatgaacgaagctgaagagctgcgcgtgaaaaatctgcccgacacagtcgaagatcacgaacgcacgatccatctcaatacgccgaaactgaagtacgtgcgcgatctcgtggaaggcgatgtcatgcgcgtactgaccggcgaaccgggagtgatcacgtcgctgacaggcatgcacattggcgatctcgagtacgtgatcatcaagggctacttcaaggctgacggtcagccgttcaccaatcgtttccgcaccgactcaactgtagaggtttactgatcatcatggataatcacgttcatccaggcatcttctttctgtctaccttcgcctgtttcgttctcggcttcactttagcgacggcgaagttcgacgtgtcgattgaccaacgtcaagtcaccgaaatgatttcgacgtgtgcatcgcatggcggcatcaagcacattcgtggcaatactgcaacatgcaattccggtatcgaagtcaaggtgaagggaactcgctaatgccgctcgcgtgtgatcatgcaccggtgacggattggtcgattccgtggaattcggttggtccgtacgaggttgacagctgggagactccgtggtccggtcttcgtggttatcgcgttgtcggcaaacacggatttcagctgcacacagaaaaaggttgcgttatccagttctctgaggaatatgctcgcgaactatgcgatgccgcaaacgccggaatcttaccacgcgatcccgaacctgtcaacctatctttgaggttgcattgatcctgcaaattatgtactataattgcaagacaaacggaaacggttgacatcacatgaaagttgcagtcaagagcgcggttcaactccgaaacggtgatcgctacctgaacacctccggtgaagtcgaaacggttgtcggggctgttgatcgcttgggtgatcacgtgaccttcgattccgtcaaggaaggtggtttcggttcagacctgaaaatctaccgtttcgccgatcccgtcgaagttctcgtctaacttcctgatctataaggttgacaaatgaacgatattgaggaccgcccggcgcggcaactgaaacccggtgatactttcgtcgggcgcaagggctggatcgtgcatatcgaatcggtgacgaagctgaatcgcgtgcgcgtgtccgggttcaatgcatacggcgaaccggtccgctgcaactacgatcctgccgatatggtgaccgtcttcctaactgattgattctaaacggcaaaatccggtcaaatcttttgaagaaaaaggttgtactgttcctatgtcctgtgtattatacttgcaagacaaacggaaacggcggaacccaaacatgaacaagatcaaggccatcatcgaaaacctgaacacggtcctcgctcccctggatgccgacgttctcgaaaattcgatcaagtggggtctggagcgcaagcaggcgattcgtgaattcaaggcggagaacatccgcaacatggatacgcattcgttctatgccggtgtgtttgcggttgccggtggcaaaacgtggtacaacatcttcaacggcatgaatgatgcgatgatcgtcgacttcatgacgaagaattgcgaacagctgatcgcgaagcgcaatatgtccatcgcgaagaagctcgaaaagttcggtgtgacggaaatcgtctcctcggaattcaaccgcacggatgacggtttcgacggtatctacgtcgtcaacacggacgccggtcagaagcgcgtcatcatcgaaacgattgtggcaggcggctacaacatccagcgccgtcacctccgcgtcctcatcaaggtgaagtgatcatggtgacttctctcttttcaaaacgctactctcatgcacgagggtggcactggaaattcgaacgggagtgctacgagtcaactgcaggggcgtggttgcaagtgttcaagcagggcgaacccgatgtcgagttcgttctctccaagaaaaaaccgaaggtgaagtgatcatgtactactacgacaacgccgacgtactgacttccgatgaacgccgcaacgtgcgcgcatacgtgaaggagcatcgctacccatccgatcagcgccgcactcgccgcaagatgcgaaagttcctcgcggacacgcgcgcggaaggtcagggtgacggcatgttcactgcagtcaaaaagcccggcaagttcatctcggacaactaccggtcgtcgcgcgactacaagatcgcgtatgcatcgaagcgcgccgaaatcgaattctacaaccgcagctgggactactgatatgatcacgatgaccgattccgaaattcgaagtctcgatcatacttctatcgggaatctcgttcgcgcatggttcgcgatctgtgatgcagccgattctgtcaacccggactggatgttctacggtcccatcggcgaagacgcaatcgtcgcgatgatacaacagctcgaggtcgcaccgttcgaactcggcgttccctacaagactctcgcaggcgaggaagtcattttcgtcaaggtgaacaacgaaggcacgcactacgagacgatggagtgtgctgacggcgtgaatcgttacacgcgtcgcgactacgggcgtgtcaccgggtcgcctttcaatcacgaagatccgcgttgcgtgatcccgcgctaccgcgtcaaggagcagtgagcatgtcgatcttcaaagatgaataccagtaccgattcgctgcgcacctctatgttctcgccggaatcggagtcaccatctttctcttggcagttggtaagttgatcgtcgatgtcgggtttgtcgttctgattccgcccctgatcatcggcgctgggttctggatctacctcatgctggtcaagttcgttgagcggctcatcatcaagagacaggagaagaacaagtgaacactgccgtgatcatcattccgtacctgatcatccttctcttcttgctcatctggttcattctcgcgaaggcgaaaccgatgatcgaagccgcgaaggtgaaggaatcgaaggagagatggcttgccggtttcgatcatgcagccggtattctgctccgcaatgaactgcacgatgaagacatgacgatggacgtcctgtatgcacgtcttgaacagtcgcggagcgccggtgtgtggaatgagaacgacgacggcgtacttgcagcactgcaacagtggaagaatgagtatgctcggtaagtatcgtcttcatttcgtgtccggtgcatcatcgccgtatgctgaggaagttccatacgcaatcgaaatctatgcgcactcgttgcgtgatgcgaggtttgtcgcaaaccgtatggtatcgcaacgcggtgtcgcggatcacacgcgcttcatcgacgcggaagaaattccaggttgacatggtgtaaccacacctgttagcatgcccacacaactcagtgagtaaatcatcatggcaaagtctgcacaagaaattttcgataccgtcgcggcgcatctgctccagcagaatgcaaggtctgtgcgaggtccgaatggcgaaggttacaacccggcgcaatgcatgtatcgcggcaatcacgggcgcatgtgcgctgtcggttgcctcatcaccgacgaagcgtacgatatgaacctcgaaaatcgcccggtagtcaactacgacgtgctgcgcgcactcgtgaaatccgacgtattcgactcgaccaaaacgatagatagtaacatcgagaggcttctcagcgatctgcagtcgattcatgacatgacaacggttgcaagttggaaagacagccttcgcgatcttgcgggtcgctattacctggagtggaatcatggataatcagaaagtattcgatgtcgtttcgacacacctgctcacgcagaacaagaagtcgatgcgcctcaacaagtacggaaacgaaacttgcgcttatcgcggcaaggacggaacctcgtgtgcggtcggctgcttgatttcagacgacgcatatgatccagagttcgaaggctttggtgcctggacgacggaagtccgcgatgcagttgaatcctctatcggcgatgatgtcgattactccgatggcgttcttctgacatcgctgcaggagattcacgacaacttggaacccgagcagtggcgcggcgcgctggaaacccttgcatggaaccgcaacctggagtggaagcatggataagacgacgaagcaagttctgaccgctgcacgcgcattgatcgcgcacgaagacaactggatcaccggcaccctctaccacccaagtgaagatggacaagactgtttctgcgccgtgggtgctatcgctcgcgctgagggggcatctttggaagctctcagcgacgacaaggtgaattccgcgttctacaatgatcagtctccggcgatcattgcggttgcgcgtgcgatgaccgatttgggaatggactcaaagatcgccttcgatggcgactcgagttctccgtcagatgtggtgtggtctggaaatgaccgcgtgcgcgatcatggcaaggtgatcgcagcgttcgacaaggcgattgcatctctatgaaaaagtacacagaactagcaaacgaaggtcgccgcctgaaagcggcgattgatgagaaccagaacaagatcgatgcgctcctagagccgctgatagaagcggcaggattcgaactgatgaataattcagtttcgagcgtgtatatcggcgcgaacagtgcgtttatctatttccaaacgggtccgagcttcgaccgatacgaggatgaacttgtcgttcccctcagtgtctgggaatcggatgatccggtaactgcactcgcggcatcacgtgtggaagctgaaatcatcgaagctcgcgaggcagccgaacaggaagagcgccgccgcaaagatgagatttcgaaattggaacatcgtctccgcgtactgaaaggtgagtgaaatgtgtcttccgttcttccacaagtgggaattcgaacagctccatgagatcaaagtctatggagcgtacaacaccacttatcctcagtattacaagtacgtgtatgttggacgctgcaccaagtgtggcactatcaagcgaaaggtgatcaagtcatgacagctcgcacacgctatccagctagagacctcgaggttttgctcctcgcaaaggaactcattcgagacgaaagcaagtggatcaaaggtgagttcacaaacggcaaaggctgttactgtgccttgggcgcaatgaacgtcgccgaagacatgacgacgttctggaacgaaggcggagtcatacgtcttcaacgttacgtcgaagataacactaagtattcgagtgtcgctgtcttcaatgacgcacccggcacaacgcacgccgacgtgatcgaaatgttcaccacggcgatcaatcaaacgcgagaagaattaaacaaggaccgatatgtctactgaactaactgtcggcgctgcgcatgagtggctagactccgtgatgagtgaactgctgagcaccggtgacgagtacgaagtcgaagatcgcgagatgatcgcgtggatcaagaacgcactcactgtcagtctcgcgcgagaaatcttccatcagtcgatgcttgatcaagtcgagatggcgaagaacttcaccgaagcaatgcgtactgagttcgaattggtcggatgtcgactcgtcgtcacagatgaagcgatctatgccgaaaacgactaccagaagaacgcagagcgctatgtctggctgcgcgaccttccggatggttcgacttacgagtgcatcggcaacttcccaggcgacatgtgggacgaagcaatcgacaagggcatggaagagaacgaccacaacatcgacggataccgaggacgcaagcatgactgatctcatcaaaccgccatcgcgcctcaacggtacgcccggaaacgtgcgcgtgttccttgccggtgcaatcgacatgggtcgggcagagccttggcaggaatacgtcttcgactggatgtgcgattctaactttccgctgacgctcttcaatccgcgccgcgaagattgggatgcgtcatgggaacagacgctcaagagcaaacagttcgtggagcaggtcaactgggaactcgacaacatcgagaaggcagacatcgtcttcatgtacttcccaagcgactgcctcgcgccaatttctctgctagagtttggactcgcagtcggactcaagaagaaaatcatcatcgcagcagatgaaggctatcaccgtcgcggaaaccttgccgtcatgtgcgaccgcgaaggcatcgtacttcatcccgacctgcaatctgcgatcagtgaactgcaacgcaccttctattacctagattgacaccacagccttgatcgtgttaccatgttcgcaacagcgaacctctcagtgagaatatcatcatgacgtatccgaccaacactgcacctggctatcccgaattcaccgatgcggaacaacgcgcacacacgcgacagctggctgacatcctggagaacattccagatcagtttttcaacatgaacaactacacgaataactacaacgagtgtggtacggtcgcgtgcgcgctcggtcacgccgcgatgtccggtgcgtttccgggactgtcggtcgacttcgtagagccgggaaagtacagcgccgaactcgcagaatcgatccttcgcgttgagggtcatccagacccgagctggtattccaccggcgtcgcgtacttcgggtatggagtgaaccaaaatatcttccatgagatgttcggctgtgaaaaggatgaagtcatcgatgccttgcgcaattggagtgaggaagaatgagtgcgttcgatgacggcgggggcgcatcgttcgaagattccgcgcgccggttgatggtccagaacatgaactcgggtcgccgcgccggtcaagcctcctttaaggaagctgtcagcgacgcactcatctcggctctcgcctggggatcagttttcggtcccatgattcctgcacatcagtgggatgaactgcgcgatctgcaggtgaaacagcacatggagaagattttcggatgatcaagacaatcgacggaatcacgtggaaggcgaagttcacgcaccagcctcgcatcggtttcgataatctcgtctatcgcatcgacgtgtggaagcacaaacgttcgggtctcggttttaatttctggagtcacacaaaagaaacttactgccgtagctatgagttcggcgacgagaacgttctgattaaagagatcgaacgttctcatgccgctctcttgaagtccctccaagtcgcggaagtaagtattcggaagacggctcactcgcgccgcagttggctctgggaaatgttcttcccgactcaaaaggagattgacaagaatgcgaacgtttgaatctatcagcatccccgagttcattcagagcaatgaccggttctactctgccgcttcatgggcacacacgcatcacgaagatgcagggcagtctcgcgaatcgactggtgagccttacatcgtgcatcctatggaagtcgcgcaactcgtgttcaacctcggcaaccagtttgggtatcactcggactggatcgatgttgcagtgattgcagccctcctccacgacaccatcgaggacacggaagcaacctacaatcagattgaggcacagttcggcgccaaggtgcgcaacacggtcttctggttgactgacgtgacgcaaaagtcgcaaggcaatcgtcgcgttcggaaggaactcgagatcgaacgcctcacgtatgcgcccgcacgtgcgaagttcatcaaatgcgccgacatcattgccaacgcgcgtacgatcattgaggacaagcccggcagcgcactcctttggctcacagagaagatcgccgtactttccgccttcgaacagtacaacatgaagcacaaaggcacggaaaatccgggcaagctggacaagcgaatgctcgatgtttgccgacgccacgtcacgaatcagatggataaggtctccaagccatgagcaacattgcgatcagacacgccgacgagctgttgaataccatccaaactctgtacatgagtgttcaggacatggagaagaaggcgggtcaacacatccaacccctcctcgacatcctgcatcctgccagcaaagatcacgaacgcagaatgttctcgtgctggaaagatggcgatgcattgtcggaagatgccgtgatcaccggctttatgtacgatggaattgaaaaggttgtgcgcattccgcgcgaaatctgggagtcggaagacccgatgcaagcagctcgcgatcacatatcgcaacagcccgcctgcggcgcagatcgaaaggatcaagtcaggaagcagattcgtgaactgcaaagagaactgcaggcattggagtatgacgatgagtgataagaacgtttactggattacggtccacgaacagcactacccgaatcctgggctgcgcgacctctacgaaacgtacgagtgtacgattgaggaatcatacttgcacttggagcgcgccgccgcactatacgatccaagtttcactctgttcctccttgacgtgacggacccgctcaatcccttcactgaggatttcatggaaggaactcgtccttactaatctgtcaacctccttgaaatcccgggtgtgactttgaggttgcatccgggatttccttgtgctatgatttggtatcgaaaactactggcacgctctcatcccggatgttccggcaaacgagtgggtctccctacgaagaggaagttgcatgaaaggtctgtgcttgactaatgcaattgtttggacgttgtgctgtatcttcggaaccggcatggtgccgttcttcatgtgcatcaccgcatggattcttgtggttatcgcgtatcagcccgaaaaggacaacacaggggaagtcgaagcatgaccacggaagacaagcactacctcgtgaccgttcacgacaagttgaacaacaagcagcttgagtggaccacctattcggtgtcggttgacgaaatcaagcgcacgcttgagccgatgaaagatttcaagttcatatctgcacgggtgatcaatggctaaggaagaaaggtacatcttggtcacggcgttttcgtctctcgatctcatcaagatggtcaatcatcgtctcaataccggttatgagtgtgtcggcggcgttgcaagtcgcggtggtgagttgattcaagctatgctgtcgaagcccgaagtcccagtatttccgtacaacccgatcccgagatttccagagtgaaacttccacgcgcttactcgaaatgcacgccggaacagcgtcgcctagtccgcgaggaatacgtgcgacggcagaacgggcgctgtatgcattgcggaaacgatcttgccgcaggtccatcgtccgagtttcgttctgcgcggatcaataagagcctatttcctaagaacttttttaaacatccgattcatctgcatcactgtcacaaaacggatatgaccatcggcgcgatccacgcgcaatgcaatgcctggttgtggcagtacaaaggagagtgacttgaaagtctacgtagtttactacatgtacacggaaacatactgctcgccttatgaaagtgagtgggagaagtgcgagaagactcttctcgccacgacagatgaagaacacgccaagaacgagcgcgatcttcacaacctgactgcgggttggtccaagcgtgccgaaatcaagacttacgacgtggtgacgcgatgatcattaccattctgctcgtcttgagcgcgttgctcgtcggcggcgccatcggtatcaatatcggtgcatcgtcaactgaaactgcgcaaggcgaggtcgttttcatccaagatgcatgggaagccgcaggtggtaatcccggcatcactgcgacgaaggaagaacttttcgacgcactacgaacactcgatgaagtgtgcgacgaagccgacaaggttccagatgaagtcgtggttttcatgaatcacattgaagagctgcaagatcaagggatcattccggaagacgtgttcaacatcgatatctggaatgccgtcactaacgccgtcatgcgagaacgttatggaaatcctgtctgactccgaagtcaagttaattccgggtgacatgtgtcatgcggaagagctgtatgcgtgcatcgatgcgagccgcgaacaactgacgaacctcacctggtcacctcacgcaaccgaacagagtacccgcgaacatctcgcactctgtcagcagaacgatgaactgttccgaatcatcacgaacaacggtgatgtttgcggcgcgatcacattgcgtccctacaaggacgcgtacctcatcggatactggttgaacacagcgcatcgtggtcgcggtatcgcaggcgaagctgtgcggcagatgctgcaactgtctgaccgcgacgtctacgcacaagtacgcttcgagaacgaacgttcgcagaagcttctcgtccatgccgggttcaagatgatcggcattgacatgacctcagtcatctataggtgggattacgagtgaaaaattatatcttggggcttctcgtgacgtttatcgttctcggtctcatcggattgatggtcaattccatggtcgaaatctcctgcgaacacgcagtgacagaggcggcacaaatcgaatcggtgatcgaagaatgcaaaacgacggcgacatgcgtggtgacgcctgacatcctcctcaaacaagcagccgcacgtgaacaccacgcgcgcgtgtgcaggaagtgacctcatgaaatttttgaatgtagcggcttgcatcatcggtgccctagtgactttcatgatcgtgtcgcatatcgacacacgacagcaagaaaagtaccaagaaaaactctgcatcgaacttcgcgatcaatacgagtcgaaattcaacgcaatttcgcagtgtgagcagaacgtgggtacgtgcatgacgacatcgacggagtatgagaatctcgcagacctcaattaccgtttgtcaacccaatgcgctttgaaggttgacaatgcgaagattgtgcagtactgataagaatgggtgggatcttgtgcagtactgataaggttgcatctgtcggctgactctgtatacttggtttcatcgaaaacatttgacggaaacgccgacatgcaccagatcctcctcgctctgaccgattccgaatccggcgaagaatgcctgtccctgatgacggttccggaagtgacgccggaagcgatcctcaaggtgtataatgagtactacgcgaaggaatacttcggcgaagtcctcccggcgaccgtcgaggcgtgggtgacggcgggtggcaatacccacgcgatcatcctgcgcgagggcgacaatcttctggttaccggtttcgtgcatacgcggtttgtcgaggctggtcgcgaatttcaccgtttcaactgagacccaatatcatgatcatgcgaaagaatcacttcgtccgtgacaccgttgcttacttcacctactttggtgctgtcgagcgcgtggtgatcgatggattcgagaagaccagcagcggcgcactgaacatcaagttcacccgcctgcgcgatggtttccaggataacatctacatgagtgatgcaggtgtccccggtcatcagtacgacagccgcccgccgtgtttcttcacgactgaagctgaggcaatcgagaacgcacctgcgaacaagcgcttccttcggggtagcatgtgagcaagtaccgtgtcgtagagcgcgaagatgggatgttctatccacagttcaggcttctgttcatctggtggaacttctccaatgaaagctactacaacccgcaatcgatgaaattcgtttcagtcgaacgcgcacgtaagtacatcacggaccatctcgaaaaacaggcgcatcagaaagagcagcgccgcgagaccaagagacagaagaaaaagaaagtcatccatccctatccgtgaggttgtcagtggctgaagtacatatcaacatcgatcatgagttgaagttcgcaatcgcggacgcggattatccgcatgatcgcatcacgggtccggtcgttcgcgcgggcacgaagggcaagtggcattgggagctgaccggtggtctggtcgaaacgcccgatctcatctgtgtcaattacagccttccggaaatgtcggcgcctcgctaaaactctgaaatcatcatcatgaaaattacccttgacgcaatgcggaatcatctcgattccatggaaatggtgcgcttcatcgaacagtcagtcggtgatcgcaacttcgtgatcgtgtcatacatgatctcaacccctgacatctgggatgcgccgttcggaatcgaagcacgtggtatcacgttcgatgctgacactggtgagtgcgtgtgccgcccgttcgagaagtttttcaacctcggcgagaacaagtacacgcagccgaacgtggtcgaacagctgatcgatctatcgagccaggtctatgtcgctgaaaaggctgacggatcgatggtgacgccggttctgatcgatgacgacacaatcatcttcaagacgaagaagtcgttctactctgacaccgcgaactccgcgaatcgtgacgcaccggaaaacgtgcgccgtctctcgatgggtctcctgctcgcaggttacacgccgatcttcgaatacacgtctcccgactggaagatcgtactcgactacggtgaagaaccgaatttcactctgctcactgcacgtcacatcgaaaccggcgcgtacatggacccggcttacctgatgttcctcgcagaacaggaaggtgtcgatatggttgacactgtgatctatccgcgtgccggatcgggttacggcgaagcgatcatcaccgatcttccgaagtatgcagagaactacgaacctgccgcaggtgaacgcggcatggaaggctgggtcatctacacggatgcgcgacgcgtcaagatcaagacgaagtggtaccgtgaccgtcaccacctgatcgacattcgcgagcgtgacatcgcagagctgatctacgacgacaagctggatgacatgatggtagaactggaaatcgccggtgcgaagatggaccgcatcaaggaaatccaggacatgatcatcggggaaatcggatgcgaactggattttattgaaacgtacggcgacctggcgaaagatctcccgattgcaggaggggcacgttacaagtggctcttcgacaagaccggttctctcgtcaattttgccatgaagtacgcggcaaccggtgaaatcgatacggaccgcctgcgcgaattcatcaagaagcgtgacctcaagtcgtggagtcttcgcggcatcacaaacagcaattttggagcaaaagatgagtaacaagccgaagttcaaccccgcaaacctttctgacaccgagattttcagccgcctcaaggagatccacgctgagatcgaaaagctggaggacgttgcgcgtcagcgtggacagatcgaaatccccgagggtgagtcgacatacttcctcgaagatatgggcttccatcagttctggcaggcgtcgcagagctgggtaggtagcacctgctaatgagtaagagtcggaaggatgcgcgtcgtaatgacagcgacgcaaactggaagcagcgtcaacagaagcgcgatgaacggcgctatgtgcgccagaagagcaaggattaccgcgatgtcaaagacaagtggaattaaggaagcctacgacatcatcgaagatctcttgcagtgtgcggagatcgggcgatacgatggcaaggtgacttccgctgcgaaagattggcttgctcagcaccgcattttcctcgcgggtccgagtgaagtcaagatcggtaatcgatactggacgcaagatggcaaccccgtcatcatctgggcgatcaccgaagacaacggctgttactgcaacgacttgcgctatcactgtgcgacaacactcagggatcgagaatgacaaccgaagccgaatgggtcgaaaacgtagagtaccttctcaaccgctgcccgcataccatccgtgtgcgcgaaggtggcggaccggaaagtctcatcgattctctgatctgcacattcatgcgaatggagcagatgatcgaaaaggaaaagacaaatggctaagctagcgaccgcccgtttttcggcggaaatgattcaagagcattgctcagaagcgaagacgaagctcatggaacaacgtcagttcgatctgcgcaaggcgaaagaccggtggttgaagaaacacaacaccaagtttcggacgctgcttcgcttcggcatgttgaagacagaagaatccgctgaaaagtggcttgacgaaaatgaagggttcggaactactatgcgtatgcgaatcgaaaagtggcgctacggcgaagacgaagacgtcatcaatgaagttggtcggctcgctgagaaggcatgcgattccgcaatcgggcgtgagatgaccgtgagttccgaggcgtccctcgtcatcgaagcgtggagaaaccacaatgtgcgataacaagtgctgcaatacagttccggtttcgagtctttatctactagaatcagcgaaagcagcccttcaaaagatcaaagaacagaacatcacgaaccggcatgctgcgatcacgcggcaagttaagcagtctcgtgaactccacgaaaacgagctcttagttcgttggggcttgaagaagaaacacctcgattactactgggacgactatcgaaaagcattgttcgatgacccttcacggttcgatacgcgccgtcactacggtggcgtgcagaagctgtgtcgtgacgcaatcaaaacttgtgaggctggggacatgagattcaatgtcatgctagctatgagtgacttcgccgatctcgaaacatggaagaatgaaagtacgatcacgcccgatcagagaatggtcgattccttcttcatctggtgatcgtcacgtaggtcaaacgtcgagcgatccttccaaccgatgacgaggtgcgggaagtacttcccttggatgttctcgttgagataacgtcgcgtcactccatcctccatcatcgtatcaagcacttctagcttgaactgcaaatagacttcgtgaaaattcacatcgcgcttcagttcatggagcgcgatgatttcgcgcttgaagttttgcggaccttccgtcttgaccttgtctttgatccagtcagacgatgagaaatatttctgccaatcggacatcgttttagagcgacgtgttttgcccttcgccttgcgcataccgtggaaaaatttcttcccaatgtattcctgacctgtcggtaggtacgtgatgagatacacgaatccggcatgatttccgatcatctcttccgtaaacggttcgccgcgatacatccacggttccatcggaattgcagcctttttgctagttctcgccatcgatacacactacctgtcagttttcaactcagaatcagtaactgcctgattccactatggatttgttagcgaaggggtccccgctaactacttgattctactaggaacctcaaatcagaggttgatcgcctcccaacggcgatacgcgaatgatccgacaatattttgagtattgttcatgttcgcgaagctgatatccaacgcacccacggcaagcggatacgcttcgaacagcctgacgccgtatgtgcggcgccccgtttccgtcacgtgccacattctgatgtccgacacgaattcattgtagaaattgagcgtgttcgaacgaacattgatcaccgtattctgccacaggtcgaggtaacgacgtgtgtctgcgtcgccgtcagcatagaagctgaaggtgacaggatcgtagttggcactgtacggcgtgcggaatggagacgagttctgaagacgttcagccgtcgcaagtgagcgttgagggaacatcgcagtgtgacacttgatgttgataccacccttcgcgttcaatgccagctcgcgcgctcgaagagcaccggcgcccactgaactgtgagtgaagccattcaactcaccgatgacaccttgcggaagattgaactccacatggtatcgattcgggcgcatgatgcccttattgaagtgagataggaactcttgatgaactggaagtgtcatgttcggcggcgtctcttggatgtttgattcgcgccccagacttggctcgcggatgccttttggaactgttgcagcggaagcatcgcgaccttttcccagtgcgtgtcttctactttgatcaaacgcgtgcgcacgtgcgacgcgaggtatcggtgaacgcaaggtgcgaacaactcgtgcttcatgacctccttcaagaagtcataggagaccttcatgtacgccttacgcgtgtgcgcgcgtcgatggaagtccatcaacttgtctaacagcactgcacgcaaacgaggcggcaggtaatgaaggttcaagcccaaccacccgtcactgtacatctcaatagggatgacgaccggcagtgtatcgtaccaaggcagtgtgtctttgtgcttcggatcgtactgatagatgaacatgccgccaataaacacgttatcgcggtgacgcggcttgaatgcatcggcttcgatgccagcgcgtttgaatttttgacctgcaaggctccacaaccaggctgcagcgtccttagacccttgctttgtcccggcgtctaccttctgcagaattgtcttcttcggtggtgccatatcgattatttacctgttttcttcttaggttttgcaatgccaagatcgaattcggtcatgatcacgaactccatcccgttttgtttcgcccactgctgtgcgaatttccatttgtcctggttgacctgataggtgtagcactcggaaagatagcgctctggcttcttgccgcgcttcgtgggtgcaacggtttgtgcgtacggcttgatctcaatcgcaatcgtcttgagcgtgccttcagtcgtcttgtactgcacgacgaaatcaatccaatacgtgcgctgcttctgatcggcttctgaccagtacggaatcttgagaccttccgagttccacttgaccacagacggattgaggtcacaccacgtcatcatgcggcgttcccaatcactgcggaagaagatttcagccttcacaccaacgtacttttcaggatacactggttggaatttgccttgatggtatctgccaactttcattctgtgcgttaaatatggtagtatttctcaatatttacgacgatgccagcaccgcaaatcctacattatccacccgacctcacggatacgaacaagcatccggcgtggattcaattcgacttcttcaaggtgttcaagcctgcaggtccggactcggatgagaagtcggacatcatccaactgtacatgcccgaacaggcatcgcagcctagcactgtgagctggggtcaagagaatttcggcttcgtcggtaacgcgctccgaaacggtgtgcgcacgggcgtaagcagcggcttcgaagcaggtatcacggaagcatgggactcactcgaaggcggcggaagcctcgcaatgatgcgtggtcttgcgacagccggtagccaggtggcatcgatgctcggaggtagtgtgtcggcggaaggcttgatgggctctgtgatgggtaagattccgaacccatatctcacagccgttttccgtggtgtcgacttccgcacgttctctttcactttcaagttctatccgttccaagcatcggactgcgacgtgatcgacaacatcatcaagacgttccgtcgcaactcactccctgagtatcaggaaggcgaagcgttcctcggttacccaacatgcgcgcagatcagctacaagtggaaaggcaaggacaacaagtggctccacaagttcaagcgcgccgcgtgtaccgcaatcgacgttgactatacaggtcagggtatgttctctgtcatgcgcaacggcttcccatcggaaatcacagttgcgacgaagtggacagaactcgagatcgtcacacgcaaggacatcggagacggattctaatggcatttttcaaaaagtttggaactattgagtacgttctagacggctattcgaaggaggcaatgaacattgtcactgcagccgtcctcaagcgactcaacgtggacaaaacctacgtctaccagagctacatcgtacccgcaggtatgacgccggaagccatcgcgcacgaactctacaacgatgcgaacaagcactgggcgatccttttggtaaatagcatcgtaaacccgttcctagaatggcctgtcaacgacagcgtcctagaggaactgatcatcaagaagcacggctcggtgaacaagatccttcacttcattgaactagacaccggctttcaactagacgacgttgcagacaagcaaatgcgcgagtggctcgctgaaggaaacccgatgccgcacaacgtccaccccgtgacagctctcgagcacgagacagaactcaatcgcgaacgctcgcagatcacggtggttgcaccacgctacattaatcgattcgttgacctgttcaacaagaccattgaaggcaaggcatgatttctgatacatcggtaaactacggtgacctgaaaaggctcactgtgtacctcaatgacagtgacatcacggatgcagtgacgacagtgaatgtgttccaagacatgttcgcgccgactaacaccatgatcatcactctcactgatacaactaacttgctgatgtcactccctatccgcccgggcgcgcgcgtacgcgttgagtacgaaaccgatctcaacagtgtaggcgacggcgaacagacttgggacatgatcgtctacaaggtcggcgacaaggaagtagagaattcgaagacgcaaacgtacggcatctatgccgccgacaaagcgttcctgctgaatcagacaaagcgcatctcgcgctcgtatcgcaacaagccgacctcgacaatcgcaaaggagcttgtcaacgagtatctcgacgctgagatcgacacggacacatcagagaacatgcttagtgtgatcgtgccggggtggacaccgttctacacgatggcgtggctgttgaagaccagcctttcggagaacgcagctgacttcactttcttccaacagcacgacggcaagtttgcgttcaagtcgtttgagaagatgtactcgtcagatgacaactactcagacatcacgctgacagtgacacctacgaacctcaacgattcggcgggtaactctatcgttgactactcgacggcgatcaatgtctacttcttcgatcacttcgacgcgttgtctaacctgtcaagcggctactacaagaacaagactgtgtcctacgatttcgtcaacaagacatggagcagcaaggtcttctcattcggcgatgacaacagtgaggacaagaaaatgttcgcgctcgatgacgcgtctgccttcatgatggagtcggacaacgtaaacatctcattcatgccgaagcacgaaggtctcttcgatgcaggtccatcatacctcgacaaggcggacgtgtggcagacaagccgcaagagctccctcatgaagtttgagcaagagaaactcgtcgttcagttgccgggttcagccgcagcagcacaatggttcggcaagagcatcgatgtcgatctaccctcacaagactcactcactgatgagacgtttgaccgtcagcgtcgtggtcgttacctcgtaactgccatcgggcacatgatcggtaaagacacctacacggtgaacatggaactggttaagaagcgactcgaagaattatgatccaagcacaagcacacaatttcacctatggtccctacacttggtttgtcggcgttgtcgaagatcgagacggcgatccactgcacctaggacgcgtcaaggttcgctgtttcggctatcactccgaagatacgggcgaagtctcgactgaggatcttccgtgggcggtcatcgtcatgggtgcggacagtgccacaagtggtggtgtgggtcgcgcgcctgtcggcttggtcaacggatcacacgtcgtcggcttcttcgccgatggtccgaacgctcaagtgccactcgttaccggtacgattccgggtatggtcaacggcaaacccgacactaacgaactggtgcgcggtgaagacctcaacaacacagttatcgctgagaagaaagcgaacgtgttgcaatcgaacgcgctcgcgtccgcgcgcgatgcattgagtttggctcaagctgcaacgaatgcgactaacttgatccagaatcaagcactcgaccttcgtaagaagctgggcatcctcgatttcaagctgccaacaggtatcactcagatcaagggcttcgatgatgtcaccaacatcgccgggcaactgcgtgatcaggttcagcgaatcgaacagcaaatcttccaactgcgcacgattcaagacagtgtggagaatttcaacgcgaagcgtctcgtggatctcgaggttgctgggttcaagaacagaatcaagtccctgcagtatcacatgggtggcgcacaactcggtgacttgcaatcggcagttcgcagcatcgacaacatcaagaacgccgcgaacactctgcagaaagcggactcggctctacgcagcattcaatcgctcgcaggtgctgccggaaacatcaagcgccttgcgtcatcggttgcgggtggcggcgcagtgaagtcgatcatcaactcgctcaccagtggtgcgttctcaaacacgtggtctgaaccgccaacacccgcgaatccaatgtacccactcaatgacgtgtatgtcacggaaggtggtcacattgtcgagcgcgacaacacacctggtgcagaacgcctacacgaataccacccaagcggaacgttccacgaagttcacccgaacggaacggaagtgaccaaggtcgtcaacgataaatattctgtcacgatgggcgatgactatgtgcatgttgacggcgacgccaaagtgaacatcacaggaaaagcgaacgtggtcatcaatggtgattgcgttctacaggtgaacggaaaccgaactgacacgatcaatggcgactatacagtcgcagttggtggcgattacagcctcgtcgtcggtggtgctcacaatcaaacagccgcaacgagcttcaaggctcttgctccacgaatcgatctcaacgaatgaatttcaccgaatacttagcagaaaaagagacgctcaaggacagtgtgatcacgtcaagtgatcgctcttacttcggaatgcaactcgaagattttgaccccgaagtcgaggatgagattcgccgctacaaggatggcgcgaacagcactaaacaggatcgcgaccattcaagttacaagggaatgcacgacctcgtacaggcgacgaagttgaatcgcgagtacatcgtcttccgcgcattcggcggcaagtatgaccgcactgcattgaaggtcggcgacgtgctcaaggatcgcaatttcatgtctacatcgcttcgttggagcgtcgcacgccagttcatcaatccaaaggcgttcaatgacaagacgaactggattgcgcgtatcgtattgccgaagggaacgaaagccttctacctcgatgttgtcgagaacaaacacgaggaagagaaagagattctcgttgcaaagaacgtggcactcaaagtcacaggtttcactgagatcaacggcgtaaaaatcgttgaaatgaccgcataaatacaagtacaaattacacaggatcacatcatgccaagcgcaacatctacaaactatctccacaacaactggatgcgcttcctcttggaaggtcaagcattcacacctccctcatccgtgtgggttggtctctacacaaccgttcctaaccttcagggtacaggcggcgtcgaagtgagcacatcgggcaccggttacggtcgtcgtcagatcctttccgtcgatgcaagctggtctggtccggcaggtacaaaccaggaatacagcaacgcgcaggacatcacctacaacgtgccgacagccaactggggtacgatcacaggtgcaggtctgttcgacgcggaaactgcaggcaacttgctctacatcgcaacgctgcagacgcctaagacggtgaacaacggtgacggcgcgcctcgcgtcctcgctggacagcttcgaatcagccgcgcgacttgctgatatgaaagacactgagtgcagcggcttgcggaagttctggctgttgcactccctttcgatcttactggcgatattcacagtaatctcgggaggattctggggcttcacagaactagctacgcgcgcgaacgagctaggtgcaatcctcttcggttcaacactcgcagccctcctcatgacgatcatcaggaagtggacgtgggagaagaattcgaacgacgatccgccgcccgaagttctgaaagagttaccagacgaatgcgaaaaagaccccgattaattcggggtttttcgtttcagagatagataccgtctgcgactgcagagacacaagcctgacgcaccaacgtcacggctagcgagtgaacactatcgaccttcaacgggcgcagaatgtcttcgacatcgcggattcgcccgggtccgaggacgcctgtattgctcaattcctcgagttccatcgcgcacgcgcgcaagtgaatattcacgtaatcctgcgcgtccttcaaaatcttctggttttcgttcataggtctctcccaatttagtagatgataaaacacgcgcgcgtatgtgtcaacctcagaatgcgccgtaaataatggaacaatacttaccaattttgcagagatattcatggcaggattcaagcagacagtccaacagcacgcaccggtgatgttcattacctttgacggcgaccagtacgatccggtcacgcgcaaggtaacttcgtcaccacgtcgcatcatggacgagagcggattcgctaacaacgcgattgttcacaacgagagcgaagacttcccggcgtatcgcatgggcttgccttcgcgcgtgaacctcgaaccaactgatcagcactctgcatcgttcggcttctacggtccacagccaactgcaccttcgcgttatccgaagtctttccttgaagtgccgcacatcgacgcgctcggattgactcagaacaaaggctcgttcaccatcggttctttcatcaccaagcaggagaatgagaacgagtatcgcgagtggatgcgcgtcaacaacatgtcatggacagagaacctgttccgcacgatcatgcgtaaggctggttcgttccatgtctacgaatcgcactactggtcgaatcaagcgacactatgcttcgaacatccaggcggtaaactggaatggacattcccggttgagcattactacggcaacttgaagaacaactggttcgtgttctcatgggacgtgcaagagccatcgcctaacatcttcacgtgtacggcaacgatctacttcaactcgcgaatcgtcgcgcagcaggtctacaactacactgactcggttccaacatcgacatcatctgcaccgattgagattgcgggtacgatcaacccgggtgcgccgacgaatctcaatgatcgtcagacaactgacatgaccctcgaccagatgttcctgctcaacaaggcattgacacctgacgaaatcgctcgcctgttcaagaagacacgcaactacgacgacacgattctcaccacgcagcctcgcagctattgggcaatgagtgacgaggaatcttcgtcaacacaaactatggttgacctcgccggaacgatgaacggtacctactacggtggtccgtcaaaggtgatccgccgccaagcaggtccggcgctgcttccagggtcagctgcaacgcagttcgtcaacggtggtgctgcgatggtgaccaacactcagagcggctggtacactccaatcaataacttgacgcagaactacacagtcgaattctgggcatcgttcgaaaactcatcacgatctgttctgttctcgcttcaacgcgacgcgctcccatacggcggtatcttgatcgaagcgaacgtgcgcaacaatcagacgcagccaggtcacatccagttctcgacaagtgccgacgatttcatctcatcacgcttgctccaagacaacggtcaacctttcaacttctccaacgggcagatgcatcacatcgcggcagtgtatcgcagtgatcgcattgaactttggatcgatggtgtgttgcacggcacgaagacgtcgccgcgttacgaggttcacatgcccggacctggacagatttacatgatgggagcggctcctggtcgcctcaacacaaccggcaagatgaacaatgtagcgttcttcgactacgcgcttgatccgcacgtcatccgcatgagatacatctacaacggcatctatcgcatctcagggcgcgtgacgttgcaaggtgttccgcatcgcgcgactgtgcgcgtcatgagcaatcattcgggtcagctcatccgcgaagtgctcagtgacaacaacagcggcgattacacagttcacctgtacgacaattcgcttgtcgatttgatcgctctaaataagcaggacaagaacgtgcgctatcgcgtctacggtccaattacaccaacgtactacggagatacgccctaatgggttacgtcaagaagtggattccgcctttcgtcgagcgtaacaacctcgccaactggaaggaacaaatcgatgacatcgagttcaacatgatctcgtctggtattcagcgagtgacagatgttgaaggtcaactcgacttggatactgtcacggcgcttcctgctatcgatcagtacgcaggttttcgaatctattcgatcaatgacggattgcacgcgattgctccaatctatttccgtctcgacttcggtaatggatgtcaaggtctgtacagctccgagtcgtacttgatgcgtgatgtccttgcgatccgcgtcagattcttcagtgaattccaaactgatggcacgccgatcaaccctatcggtgatttccgatacccacaggcgtacaaccctggtgttggttcaaacacgaatagtcgaaacatcaatggcatgagctacatctgcaaaaacgatgagttcggattctttggtttcgttcaaggatcgggcgcacgtgtctcacctagcaactattacggtaactacgaatctgcaacgttggctattctgatccagcgcacgaccgatgcagcaggatatcctacacctgagggattcaccgtatttggctcaagcgcccccaacttcaattcgggtggtggtcctactgacaccaacggctatccaaataacgctcctgcgagtttcgtgcagtcattcgtgtatgaaagcaagattatgagtgttaaatctgatttgatggcacctcgcctgggtggagccgtatctgacgtagttggaacaatcgttgagccgcagtatatctactcgaaaactccattcatcaagactgttgacaaccttctcacctacaagcacacaacaatggcgccgggtacggaattcaacatcgaaatgtatccaggtcagcaaagaacgatggttacgctcggacaaggttcgggtttgattcctgacggtagaattggtatcgccgcacattacactctcgcaatgctttggcagtaaactatggcaagatattggagacttcttttcagaagttctgttggtcccgcacaacatcacatcacgtttgctgaacttgaactattcgacaacgatggtgtcaatagagctctcggcaagcctgtaactgtctcaaccacatatcctcagaatcctccataccatccaagtcacctcactgatggtatcaaggtgacaggaccggggttggctgacttgtcgtgggcgacgaactcgtataatgtcgatggtgcatggtgtgtagttgacctagaaagtgactacgaaatcacccttgttgcgatcaccaatcgttatgatcaatctggtctataccaaactccaaacagtttcattgttcagtacggtgattctgaagatggtccgtggactaatgcttttgacgttcacaacccaggattggttccagtctcgaacgcgacgaacaattactatagcccgaacttccgtttccaagttgcgcctgcgcatccaatttcggctaagaaagcactccctgcagcgggcagagccaacgtaagcaccgttgcaaacttcaatgtatatgtgaagaatgcacgcgtcaacacaggtaacggttcgatcagtgggcgaatcattgacaagactactcccacgaaactgacactgttcgatccggtcaacaaccatgttgtatcggaagtcatggctgaccagattggcgagtaccgattcgatggtattcgtcatgaccttcactacgatgtcatcgcaactgacatggcgacagagtgggaatcgaagatttcttctcgccgcgttccaatctatgtcccacctgttctgagcgcgtcgctcaacttcctcgacggttcgggcgtcacattagacttagagacagaacactacttcatctacccgaatttcagtcagagcacctcacgctccaatgatcacatcgtatcttatgacaagatgtacgatgatgacgagaacactttcgcgctcacatcgactccaaatggtgaaattccgtggatcatggcagacatgggaacgcgtgtcaccattgactctgttctcttgagcagtgctgtgtggtctggattcggtaatctcatcaactgggtcaacggaagtcgcctcgaatattcagacgacagcttcaactggtcggtcgcattgacggttgagggcgtgcagcctaccgggaaacttccattcgttctcgatactcctacagcagctcgctggtggagattgagcaatccgcaaccggcatcgaatgttgcaacgggtaccttccgtttcgaaggtatggcgaagaaactcgactacgtgtttgaatacacaggaaaccaagagtacctcacagttccagatggtgtcaatcgtgcgattttcactttagttggtgcatcgggcggtggtggaaactacaattggaatcacgtctcgggcgcaggcgcgtacgcgcacggcttgatggaagttgagccaggtcaaatgttcgtcgttcgcgttggtcaaggcggtgaaggtggtcatcgtggtgagagtgcaggcgccggtggatggcctgggggcggaagtgggtcgcgtggtgacgtaggctgtggtggcggcggtggttacacaggcgtcttcctcggcgacgaaacaccattgatcattgcaggtgcaggtggaggatcatcttcttacgcgaaccctgcaggtgccggtggcgctgacgttggtggtttctcgggcgaagctcaaggtggaacacaatcgtggggcggcgctaatcagtacgacgcatacgacacacctactttcgcaattcgaacaggcggttaccttcaaggcggcagtgccaacaatggtgacatgacaacgtatgtcggtgacgacagtgcaggcggaggagctggatactacggcggcgctgcaggtacaggcgatggtcgctcaggtgccggtggatcaagtttcatcaaccagaagtacatggtcggaaagacgtatgcaggctcaggcggttcaacaccaccggcaaagccaaagttcatcggggcacgtgacatcacagacataggtacaggtgttccttctcgaggtgattacacgcgagcggaacgcgggcgtaacggactcgtcatggttgaattcttctatgatgaagctccaattcaattcccaactgtgcgtcctatctacacgatgagcagccgttggcgtgaaggaatgcctgcgacgttctacaacatgaacactgccgatttcactactggtgcgggcacacacggcaacggtggaagtttgccgtacccagaaggtccacagtggattgaagccgacttgatcgagcctcacatcgtcacgagcgttgaaatttctggcggttctttgttcactgaattacctaatcgcatcaactggacgggcggtcccggtacagccggttacctcaatggtcgcctgctgcagtactcaactgatcgcaacaactgggagacgattgcaactgtcgaagtcaacaacaattcgatcaccgcatacgatgttgcaggaatcgaggcacagtactggagactctacagccctacgaccttcgttgcaaccaacttgttccgattcacatacggcgtaccaggcgaaatctattctgtctacacgatgagcagcaagtacaccccaaccacgggtgtgagccgtgcgaagatgacagacggcaatatgcaaacaggcgcaggtacgaacaacgtaacaagcagccgcgaatggatcatggctgaccatggcaagcctgtagcagtttcgaaggtcactctcggtgcgggttacgttccagactggggaacgacataccagtacttcaatgcgtgcagtgttgaatactcaaacgatctcgaaacgtggacaactgcgtttgaatgtgggacgttcactgacaatcagatcaagacgtttgacatcgaaccgcctatcaccgctcgctactggagacttgcaacaaacggatgggtcggcgcaacggaattctcattcaccttccctgcgaatcctgttgacctcatcacttacagtcagagcagcaactatactggtgttccgaatgtaactcatactgcgatgaatgattacgacaacaacacaggagcaggtacaaattacgtaggtggtgcagacgccccacctgagtggatcatggcaacattgccagagccgatggtttgtgccgaaatccacatcgggtcgggtgtgattcctggttggggaagtacacaagcctatctcgaaggcgcgatgattcagtgttcaactgatggtgtacattggacagatgccatcgagatcaacccaggatatgtagtcgacggtgaaacaatgacattcggcatcgatggtttcaatgtgcagcgttactggcgtgtggtcaacttcgacaactatgtcggcttaactgagttccgtcttgtcccgcttgccccagcataacggttaaatactagcatctaacagagacagtaaatcatggttacaatctacaaatcatctgacccaggcgcccctattctcacaggacagccaggaagtttcgttgcactcctcgatgcgctactagttggtgtagacgggatctcatacggcgataagccggctctaggatggactagagaattcggcacatccacagttgcagtttggcgaatgagcacgacagaacctggttcatcgggtgcatatctcaagatttggaacgagaatggtggcgatagtgccttcgctcgtgggtataaaaccatgtcaagtttgaacgttggagaaaacgaaactccgacagtagccatgaacgaccgcaccatgtggtcgccttcgaactcaaatgattcaaatgcgcgcggctggattttaattggcgacggacgaacgttctacatcaatatcctgacaaacggaacatcatggaccaatgactcacagtgcgtaatccttggttttggtgactacgaccattttgtgccgggtcatacgcataactttttcgtgatgaatagttactatatctataataactacgaaatttttgaatcgtggagtttggaccgcccgcgcagagaattcgctttggctcgtgactcttcagatattggtggggctgtcaatggcatgctgatctgcccgggtggacgaagtggaggacagtcatcaccaggtcatcctaacgtttacactggtcaaattcacaccgctccaggcatcgtcgcagacctacacggtttttgcggtaagatgcgtggtttacacgtcatgatgtcgcgaccttactatgactggggtcgcccaatcggacctactaatgatgcacccgaggatcttccgttcattcagatgatctcacgtcatccatcatcgggttatgttacagccgccgttgctatcaaacaagaaaactggtaaatgcttacaacgtacgagtatggaactatcacacagaacatctacctttacggcgatgttcaaggtaactccgtgctctcagattttggtcgtattcaactcaccaacttcgttccgtctcttccatactttgtagaagaattcaagtattcagatattcgcgcgaatgagtttgcaggtgcaggttatattgcaggtattgctccgggaatcgtaactttcgatggtctacctgcaatcaaagaacttgagcttcgtgaccgtgcgacgagaaaggttgtccaagtcgtcaactcaaagcgtgacggttcttattcgtttgatcgcctcgcgccgacccgcgagttcgacattatcgcgcgcgacggcacacgcacgtacacggacattatcatcccggctatcgtcccttggcgttactcgatttatgcaggagataattttccagccgtatcgaatgacttagaattcgagtacattcgaaaagttgaaggcgcaacaccaccatacacggtaggaagaaacgattcatctaacacattagttactcttgaaaatacaaccctgaaaatcaaatcagtagatgccgacctcgaatcaaatatcgattttgacatcatggattcttctggaagaaaactaacgattgcgttcaaaacgaaatccggtttgttgaccaagatgctcaagatgaacccttacattgctctcgcaatgacgggaacttctgctgttgaagaaaatctcgttggtgaacagaacgtaacagcatacggatacagtaacagtcaaggaccgcattatccaggtggcgaccttacgagatgggctaatgcagattggtgtgcgcgtatgcaagcacctgcgtctattttccccgcgacatacaaaagtttcagtgttgcgcttatgtatcgcatctaccagaagtatggtgcatatcgcttacttgcaggtcaatctgacgcagcgactcaaacgtggcaattccgcacaacatacgacaatatgcttgagttcattgccatcaataacgggactgcacaaacgatcaccactgatattactctcgaccctaatcagccgtacatgattatcttgacggttaacgagaatggtacacttgacttttacgtcaatagcatccataaaactatgtcgttctcatcacccggcatgaatttcggacatccaacagcaccattctctctcggcggctttgcgaactgcggttatcagacgttttgggcacatgggttcggaaactttgcattctatgatcgcgtactcacacaaaatgagatcaattctcttctagaagttcaggctgagtactgatgtctagaaacatggtttaaatagattccgataagaagggatttatttagcatgtcgcctggctcgaacgagcacaatatcctgcttgaagatcagcttccacctgaaacggtggaggttgacccaccagcagcgtgccaggaaatgtggacgggtgttcccggtgacatggttgacttcaagttcaaagagttctggaagcaagttccgggcgatgaagtcaacttcaaatttgagtgcatcaaggaatgtacctcactttggaagagacgtgatccgcgcttcatcgcaattccattcggcaacaaagagtggcagaactacgatcctcgcttcgttccgattgagttcaagtgtgaaacggaagacggcgacgacgttaccctgttcactggctatttcgacgctgacgaaggtgctcatgtcactttcggactcagtgattcgtggatcttgcgcgcacaagacggtcagtggattggtggtcgcacgtgtaactcaccggtcccagtcaacatggttccggcgaagtctagaaacgcgtttgtcgatggtgtagctaatcgcgtaatcatgcgatcacatgttggaactgcaacagacgcgagggcgggtgcaaacgcaactcacgttgacgcgattcaaaccaacggcgaaatcattgacgtatcgtggacccaaacgctaacaggcacatggtacgataacgacaacacagatgctgcttttcacttcatgttcgtggatgcgacatcggctgaaaacatcattctaccaacttcgacttggtcatattccaacccactctacgcagtgggcaatcgtgctttcggattctggatcccgttcggtcaagcattgggggcaacattctttgacaagagagccgaagatggcggaccttcgacgcatcagttcaacacatttggcggcgcaaagaatctctacaacggtgatgttcgaattcatgtgcaactagcacgcactagtacaagtacaacgatcactgtttggttcaatgacgtgcaggtaggcacgcacaccttcgctggtcagattatgcctgcatcggtagttccaatttggcactaccacaactacaattcgccttcgactatctacgaagcgcgtgacatcgaaatcagcggctgcgaagagttcctcacgacttatccactcgtgggtatgccggtctatgcgtttgaaggacaatcggctaacttcacactcggaacaacagtcagtctttacccgtacgcgtacgcgggcgaagaagcatcggttgcaatcgcgacgacaacgacacttgacctcgacgcgttcgcaggtgaagagctccacctcgacctcaccgttccagttccagcggcgttcgaacccttgtttgaggacggtcagtatgtcgtcgcatcactcgcgacgacatctgtatttcgagacatccagttctacagcggagagctgttctccgctgacatcgaaatttcgccagccccagacatgtcgctcgacttctggcagggcgaacttgcgtcgttcgatcttcaagttccgatgcaactcggtctcgtgcgcgcgtatgcgggcgaggcgatggtgttcgtgtcgctcgacacagccgaaaactaccagatgtacacaggtgagtcggttgaggcggtccttgcgacagacacgacacttccaatgtcggcatacactggcgaagaaacaatcgccacgctcgaagttcgtccatcggaaggtatgggcacattcgaagcgttcgccggtgagtactctgagacagttgttcgcacgctcgtgcaggtccttctgtatccaaatgtcatcagcgcgcgcgaagagttccacctcgagtttgacagcaacacccacttcgatctgctcaacacaacgtgctgccctaagcttgaaacgtatgagcgcatcgaactcacagacggtccaggtgtcgatgagaagtacgacggcgacaagacagttgtgcagatggatctcagcacgctgccacgcttccagctcaacgcgtacagtggtgaaacgttccgtctcatcgatccgaactacctcggcacattcgaagcgttcgaaggtcatgcaccgatcatcgaaaacgtgcaacctgagttcatcgacttccgactctgctacggcaacttcatcccagatgccggtaacgtgttcattgagttggtgtctcagtatcaggaagactgtgcgtccgacatcatctacactggtgaagagatgcacgttgaactcgcgaacacagtgggtccacaagcacatatccgtgtaggtgagtacgcgattgccgatctttacatcgaacctatcatgctcttccaggcgtggacgggtgaaatggcacgcatctcaaacccagagttcgaactcgacttcggtcacggtgaagaggcagagctgatcttcgaagagaagaactggtatgcgtacacgggcgaaacaatgacgattggtacgctcacaactgagtacgacgttgagttccttgagcagggctgcttggataacgagttcgtcccatcgaacgaaaacggcgacccagactgggataaattcaatgaggtcccagtggaactcgaattctacacccactcaatccaggctagatgtttttgatgaacaagtacggacaacattgctatacatatctgataggctggagaaaccttgatatatggtattatggtgctcggtgggctaacaaggtttcacctgaaaaagatttgtgggaagtttataaaacgtcttcaaaacatgtcagtcaatttgcgacagataatggtccaccagatgtgattagagtttctaaactatttgaaactgtatcagacgctcgcaatcatgagaagaagtttatcaccagaaatagatgcgttagaaacaagcgttggcttaacaaaggaaatcctaacggaaaattcactcacagtcgccctcatagtgccgaatctaagaaattgatcggagctaaaacggttgaaagatggcaagatcctgattatagagccagggaaattgccaaactaaaacagcgcgttacgagtgatgaaactaaacaactactttcaaaaagaatgcgcgaggtcatcgtcgcatcacaagaaaagtggagcgtttgtccatattgcaaaaaggaaggtacaggtctttcaatgcgcagatggcatttcgaaaattgtagaaagaaataatggcgacatgcatcgaatcaatccaggcaatggcaagctacgatggtcttccggctatcgtagctaaccaactgacgccattcactgtcacgcctgagtctaaccgactgttcaagttggaatcgccgttcgtgcaaacgatccgctttcagttcagcattgcttcactgcctgcaactacagtcgtcacgatcttctcttggaatcgttcgacaagcaccgcgacactcgttggctcattcaacgtcacaggcgcatcaagcacagccttcatcgactttcagatgggcgactacatcatgtgcgtacgcacgagcgcgggcgcacaatcgggttcgttcactggcatcttcactgggtatccggatgaagcacgattcttcttcgacatcggcgacggtcagtacttcgcggcagatgttgagaacgttcgacctccgcgcgagtgtgacgaggctctgttcttcgaagtgatcgacggtgagttgccgcctggacttcgaatggacgccctcggaacgattacgggtatgcttccgaacctcgactgccttgaggacagattgagtccggctgtcaactggtactatccggaaaacgacggcaccatgtggccttggggtcgtcagtggcgcttcaaggtgcgcgtttgggtagacggattctacgacacggcgtatgacgaggagtggttctgtgtcaagatccacaacaactggacatacgatcaggaacgattcctcgcacaagcgccgttcgaacacatcacgagcattcgcgtggtcgagccgccgtctgcgatccctactatctgcgtaccatgtggtgacaacagcccagaagcagaatcgatcttcgtctctcaacccctaaatagcccatgcccgccatgcgatgctgcgaatcaagacacagccgttgagctgattccgattcctacagagctgtgcggtatctgcgcagacgacttcctcacttggtacatccaggacgagccttccgacaatccgcacatcgcgaagttcaagagcgatctcgagcagtcagaagcctttggaatcctcctagaaaaagccggtttcaagcagggtgatcgaagcaacctcacaccccaacagctggctgataccttcatcatcactcaaaactacgagaactatctgcaactcgctcaggtccgcttgcaacagaacgacccggactcataccgcgcgacggttcaagagtggcagatgattgaaaatcagattcttccaacatcgggcgtcggatataccggcgaatctatcaccttcgaattgaccaagccttgatcgacaccatctgtccaccatgcgaagtgcctaaggatttcgtgcctgtaccagttccagacacactgtgcccggttccggaaaaggtcgaacgtccttcactactgccgacagaaacgaccgtcgatgtcgtcacagacacatacgaagatgccctgcgcaaggtgcttcgtactcacaactgcgaaactgttccaggcaagcccgagtacgttcctccgatggtgtttggcattccgccgtatggcatcgcagaagttccgtatcagttcaagttcacagccgcgcgcgggcgacccccgtaccgctatcgtgtgctcaacggcttgcttccgacaggtttggtgatcgatcacaacaccggaatgatcaccggcaaacccgtgttcgaagaggaagctgcattcaccattgaggtggaagattccgagaagcgcaccaatcaactgatggcaagaatagtaattattccgaattaacgaggttaaatagacgttatgggcatggcaatctgcagactaaccgacatgacgatggggcacggatgtttcccgcctcaacaaatcttgcagggttcaccaaatgttttcatcgaaagcctcccagcacatcgacaaggtgacgcgattcagccgcattgctgcaagacgtgccatccatcggcaggtggttccgggtcacctaccgtattcgtcaacgggaaagcaattcagcgagtcatggacaaagcaacgtgcggatcggtcctcatgaccggcgcaaaaacagttagagcgggatgaaatgaaacaagagaaccgaacatattctgacttggacttggcgttcatgccgtcgccgcttactggtgagctgaacccgaaggtcaaccttgaagctctcaagcgagcagtcaggcatctgttcatgctcaacgcgttcgacatcccgttcaatccgacgattcgaagcaacatcaagcactacctgttcgacaactacacccaactcacagccgcagcggttgaagaagagatcaggtgggtggcgaagaaggtagagcctcgcattgagatcgaggaggtcgatgttgagcctacggacttcggaaaagccgttgaaatcacagtcacatacagaattcaatcattgagtcagcaggactcattcaacttcacagtggagcgcgtcaggtgagaaaccttccagtacagtcactcaattttgacgacatcaagaacaacctgaaagagttcttgaaggggcaagagcagtacaaggacttcaacttcgaagcctcgggtatctctacactcgtcaacctcctatcttaccagacgcactacatcggctacttcgtcaagatgctcttggacgaggcgtttgtcgattccgcgcacacgcgacaagctctgttgagtcatgcgaagagaaactcctacattccacgtggtaagaaggcatctgctgcagaagtgattctgcgcgcctcgacaacactcgcgaatgatccgggtacacgcaacttcgagattcgtcgcggcgacaagttcaactcgacaaacaacacgcaagacaaccgagtgttcaacgtccttgacggttcactggcttacaaccgcgaagttgatggtgatgtcgtcacctatgtatccgaaacgctgcgcatctacgaaggcacgttgcgcacatggaacttcatcgtagacacgagcgtcgtcaaccagaagttcgtgattcgcgacgcaaacgcggacattgatacactacgcgtgcgcgtgcgcgagaacgacacgtcatcgcagtacactgagttcatgcttgcatcggacatcctcgatctcaaccgcaactcaaacgcgttcttcgtctcgacagacgaggctggttactaccagatcttcttcggtggtgacgtgttcggcgtgcagcctgataacggcaacgcaatcgaagtgacctacgtttcgacaaacggcgaatcgggcgatggtgctcgacagttccgtttcgttccacaaggtggcaactcaaactggacgttcaacactgttgttagctcggtatcgggtggcggcgctgaacctcaaacgattgaagagctgcgcttcgcgattccgaatcacatccgccgtcagaaccgaatcctcacggaaggtgacgctcgcggcatcttgctcgacaacttccgcaacatcgattcgatcaatatctggggcggcgagaagaacgaagagcgcgactacggtaagctctttgtcagcatcaagccgaagttcagtgatcgtttgacagcactcaacaagtctcagattcgcgatgacatcgtgcgcaagtacggcttcgtcggcatcgacgtggtgttccaagatccggacttcatcaatgttgagatgcaagtcgtcgtcaccatcgacctccgcaagaccaacaagtcgcagccggaagtgttcaacgaaatcctcgcgcgcgtgaacgagtacaatcagacgaagctctcgaagttcgacaacatcctctcggagattgatctgctcaacttcatcaaggcaacgaacccggctgtaacgagcatcttcactcgcaagaagctcttcaaggagcactcgcaccttcaccagagcacatcgacaaacacagttcgtttcggcaacgagttgacgcctcgcacgatcacatcgggcaacatcaactacggtgcgcaactcgtacagatgcgtgacgacggcaacggcaacatctcgctctacaacggtgacgttcttgttctgcctttgatcggctctgtcaactactcaaccggcacgatcctctacacacttccggcgaacacacgcatcactggattcgaaacagcacaaatcggaacactcagagtcgccgcaacacctacagatcctgacatccagacaagcatgaacaacattgttcgcatcgcttcaaccaaggtagttagcgcatgacaaacacaattgtacccgtactgatcgatagagtacctgagttcgctcgggagctctatcctaggttcgtgcaattcatccgtgactacctagaattcctggaaagcgatgggaatttcttgcagatcgtcaacgactggaatcacaaccttgagccatcaaacgaagttgaaccgtacatcgatcaactgttggctgacctcgggttcgaattccagcaggcacttccggttcgcaagagcctgttgctccatctcctgcgcgacttctatctgagccgtggctcggaagcgtcattcaagttcctcttcaaagccctcttcaatgaggacgtctcgatccgttatcctcgtgacgagttgctgatcccatcgtatgcccaatacggggagcgcttcttcatcttcacgacagcgaacacctacaacacggaagcctacctagctctgatcgcgcacgtgcgcgagaacggtggcgaagtccgcacggtagagtcgggtcgttctgccttcattgaggcgatcacgattcaacacggttccggcaagccctactaccagatcgagattctccaaccatcattcgagtttgcgacgggcgaaccgctgaacttgatcggtggtgagacaatcatcgccgaaaatcacctcgccattctcgacttcaacatcgtcaacggcgggagcaactacacgtacgatgatcgcattactaccatgggttcgtcattaccaggtcggttctatatccaagaactcggcaagggtaagatcgattctgtccagatcatcgacggcggcacaggctacaagatcggtcaactgatcaagaccgctgaaaacgcgggcggtggtggcttctcggcatacgtcacttcggtgaatgatgcagggactatcttgtcactcggcatcgtcagccaaggctacaactacgaattcatgccaaagttccgcgtaagtaatacacaaggaaccggcgcagtgttccaaggctcaagtacgtctatcggtgcagtgaagcgtatcggcatcgaaacaccatcggttgactacaatccggactatgttgcattcgacattacatcggagcttggtgcgggtgtgcaagtgcagccagttgcgaaaaacatctggtcgacttcggactggaccgacaacaagggcttccttggcgaaaatagcgtcctcatcgacagtgataaataccagcaatactcgtataccatcgtcagttcactacctgtttccgcatacagcaagtacgttgacgagttgttgcacccaatcggttacgtcaaggcatcatcatttgagatttcgtctcacttgaagttgacacttacaacgtctgatccgtcgctcacagtttcaagagaacacgcgttcgccgcgatcttggaattggacttcgaatcagagtcgtctatcgatgaggtcaacatgattgttacatcgggtggaacggaaatcacgtctctgccgtcaaacttcaacatcgtcacttcagagtgatttagaggattcacaatgccttacagcttctcacctgcgatcaataccttcgtgatcacaagtttgtttgactcaattcgccaggctcgcccggtgaatcgtcagccttcgacttcttacagcgtcggaactcaggtgacgagcggacagacgcgatacatcgccgttcaaggcggtacaactggcacgggcgctggtccgacaggtacgtcaggtcagttcaatgacggtacagtacgctggctcgcactcggtgcagagtccgtgttcgaaggcaacatcatcagcaacatctacctcggcgtaggtaagcagactgagtggacgaatccgacgacacctccggctccagacgtgagcttgaacggtcaggcgcaggcactcaaggatctgactgcactcgtcaaactgaaccctgaaaacttccgtctaggatttgagtctaatgcatatgaaagcggcaccgtttactcgcagtacaatccagcaatcaatcagtcgtcttaccctggaccgcattatagcgtggtcaatgggcgcaacgtctacaaggtcatcgacaacaatggcggaagcgaatctgtcgatgccccaactggaacgtctagcctcaacatcgagacgcctgacgggtacatttggcgtttcgtcggaacagttgcaagctctgaacaattcgacttcggtacaagcgagttcttgcctcttccttctaacagcacagttgcacaagctgcgggcgaaatctcaacgttcaaccacacagtcgcaacaccaattccattcgcagcagcagacgcactgactgtcggcatcatcggcaacggtgcaaacgcatctgcggttccgcgcacgaacacatcgggcgcgaacaagtcgatcaccggcttcttcgccgcatcgggtggttcgggctacggtgaagacacattcgtcctcgcttggaagtctggtctcacgggttccggttcgctcctcaacacaacagtgacaggtggcgaagtctcggcgatcacagttcaagcggcaggtacgggttacgcaactgcatcggtcatcatcattggtgacggtacaggcgcaaccgcaaccgcaacagtttcaaacggttcgatcacaaacatccagatcactgacgcaggtgaggactacacgtgggctcgcgcgttcgtgattccgggtacacaaggtgcggtagcacgtgcagtcctatcacctgatcgcgggcacggttctgacctcgcgacagaactcaacgcgtcaacgttgctgatcagtgcgaagttgtctccggctgtcaacacatacgttccgactgagccagatgtcgatgatggtacattccgtcaggtgacactagtctcaggcgtccaagctgcatcgggttcagagcgcaacgccgccgcgtacctcggaccatcaaacactaagtattccgccccgggaacattgaataaatacagagaaggaagcggctacgttctgtacgccaacaaccttagtgcgattacgcacaccacttcgcaagaagaggtcatcaaaatttcaatttccctgtaaaggtaaaccagcttcatggctaagaaagacctcaatgtatctccgtacttcgatgacttcgattcgggtaagaacttcatgcgcgtcctgtatcgtccaggtcgtgctgtgcaggctcgcgagctgaaccagacgcagagcatcttccagaatcagctctcgagcttcgcgaatcacatcttcaagaacggatcgaaggttagcaacgcgcgcacgtctcttcagacgaaggcgtttgttcgcttgactggtacacctaacgtcgaaggctacgtaggcgcgatccgcctgcacggtgagacatcgggcatcagcgcgacactcgtacgcgcagtcaacgcggacacaatcgatccagctacgctctacatcgtgtacacaggtacggcgattgacggtgtgacttcgacattcattccgggcgaaaacatccgcgtgtgggacgaaaacgacatcgaaatcgacgtgctcaacgtacgttgcccagcatgcccaggttccggtcttgacgacacaatcccgccaacaggcaagggacagttcttctctatcgatgacggtatcttctacttcgaaggtatgttcatcgaggttccggcgcaagaaatcatcgtcacgaagtaccttgagtacgacgcggacggcaacatcaccaacttcgttccgtgcaagatcggtctcgacttcgttcagagcatcgtaactcacgtcgaagattcgtctctcctcgacccatcattgggctacccaaacagtaccgcgccaggcgctgaccgttacaaggtagacatggtgctggtcaagcgcgcatacaacgatgaggacggagaagacttcgttccattggctcgccttggtgagggaatgaagatcgagttcatgaagtcggactcggattactcaaacatcatggacgcgatggcgaagcgcacattcgaaacgaatggcgactatactatccgcccattccgcgtgtcgttcttgaacagcaagaaggcatcggcaactgacccacacggttggtctgtcaacggcaaccccgatgacttggtcgcgatggtcactccatcggtcgcatacgtcaagggctaccgcgtcgaaacagtatcagacactcctgttgcgttccctaaggcacgtgacacgaagaagatcagcagcttcgtcaagaactttgacgcgcgcacgtacgtgctcgggcgaccagccggtgcggcgatctggcctaacggctcatcaaatccatcgacagtttcgaacgatgtcatccagctcttcgacggcgttgctacagcgtcgagcgcagcgggtactgtcatcggcaacttgaagatcagcgacgctgagtatgtctcgggcgacgttgcaacgcacacagcgatctaccgttactacgtctatgacgtgcagatgactggtggaaacgttctcgcaaatgcgaagagtatggtgcgcggcgacggtcagttctacacaaacatcgtccctgacacgatcacaaacagaaacgaagtctacaacgcgaaccgcacaggtctgctctaccgcatcgaccgtgacgacgtgaagtcgctccgtgacatcaatgacccgctcaatggttcgatgaacctcaacgtacgccgcaagctctcgggcgttgcgaacggcagcggctcggtcacgttcagcacatcggcgaacgaattcttcgaaaacgcaggcgcgggcttcctcgtctgggcggaaaacaacggtgtcaagacatcgtaccacggtccagccgtttcgacagtctcaccaacctcaatgacgatcaacctcggctcatcggctgcaggcgcgacagtctatgtcatcgtagacgtgttgaagacgaaccagactgagaagcagaaggtcgcgacgaacttcacttacctttcaaacacagcgccgtctgcaatcgtcggttctaccctgtcactcggtgtcgctgacgcgtacaacctccgcagtgtcaaggtgttcttggacggttcaccggaagttgaaatcgctgacatcacaaacgagttccgccttgatccgaatatcgatgatcaggcgtaccgtgagtcacgtctcgtccgcacggctgcatcgtcaatcgcattgaacagctcgcaccgcgtcgctgtcaacttcgattacttccagcactcaggtacgcagggcttcttcacaatcgattcttacgcgtcggctctcgcagcagacgattcgggcatcacgtacgaaactctcggcagctacgaatcgaaggcgaaggttacctacccactcgcttcaacaatcgacttccgtcctatcgtgatgggtacgaatccgatcacagcggttctgccttcgaacggttctacagcgatcttcgacatcgagtactacctcgggcgcgcggacatcctgcagatcaacaaggacggacagctctacatcaagcagggcgagccatctgagacacctcgtattccgaaggtcgatgacaacgcaatgaagttgtacgagatctggttgaagccgtacacatacagcctcaaagacatctcgactaagtacgtcgataaccgccgcttcactatgcgcgacatcggttctatcgaaagccgtttgacgaatgttgagtacatcactgctctcaacgtcctcgaaaagacagccgccgacatgagcatcaaggacgcaaacggacttgaccgctacaagaacggtttcatcgcggataacttccaagacttccaggcggcggacttgcagaacgcggaattccgcgccgctgctgaccgtacacaacgtcacctccgcccatcgttcaaggcatcgaaccgcaagttgaagttcaacccaatcgcatcggcaggcttccagcttctcggtaacgttgcggtacgtccgttcacggagaagatggcggcagaacagccatacgcgacgaagcacctcagcatcaacccgtacctcatgtacaaccagcgcggtacgatggtcctctcgccaaacaatgacgtttggacagacgaatcgcgcacacctgacatggtggttgacatcgacgcaggcgttgacgcgttcactcagctcgctgacgcggcgggtgtcctcggaactgactggggcagctgggttgaccagaaccgcacgatcctcggcaccgcacagacaacagaagtagttgtcggtaacggctggtggggttcgatgaacacgactacaactactacgtcgcagacaacatctgcccgtactggtacagcgacgacagttgaatcgcgtgtcgactcgtacacaatcgatgacatcgtgaaggacgtccagctcatcccattcgtgcgctcgcgcgacgttgagttctacgcaacgaagttgaagcctaacacacgcgtctacgcattcttcgacggtactcctgtctcagaattctgccgcgacatcggcttccagttgagcgcagcaaactcgggtcaggcatcgcagttggtgcagttcggttcgcctctcatcacagacgcaaacggtgaactccgtggtgtgttccgtatccctgcaggtcgtttcttcgttggtgagaagaagttcgcactcagcgacgatccgaagctatcgggtgatgcagacctcgaatcgacgttcactgaaagcgtgtacttcgcgggtggtctcgacgtgacgaagcagaacgtttcgctcaacgtcatcacacctaacttccagacggaacaggtcacagagacacgtcagacaacggaaacaactacctcacgcgaatcacgcgaaatcgtgacacagcagcctttcatccttgaagatttgtgcgtcggtaacgagcgtactggtcgattcctcggatgggaatgccaatgcgcaacaggtcgtaaccgcaacatgtgtgacgatccggtcgcgcaagcgttcgttctcgacaatgactgcttcgtttcaagcctcgatgtttacttcaagcaggtagacgttttcagcgaccgcatcttcattgagttgcgtacgatggtcaacggctacccatctgaaacagtgttgagcaagaagtactacacacctgatcagattcagccgttctgctctgacgactcatcgcgcgcgttccgcgtgaactgggacgtgccggtcttcctcgaaggcaagacacgttactgcttcgtcatcggtggtgcgtctccgaactcacgcgtttgggttgcacgcctcggcgaagaagtcacaaacatgccaggcaagattgtcgaggcaccggcgacgacagaagtcagcttccgctcgctcaacggttcgacatggaacgcagagcagttcgaacagatcaagtacaagttgcaccaggcagtgttcgaacctggtacgatgaaccttgtgttcgaaaacgatcacgaagatgagacattcgcgctcgacttcaatccattccagacacaggtcggtcagactcgcgtgcgcgtgttccataagaaccacggcttgacagaggcagatcgtgtatcgttcagcctgttcgaaaacattccgtttctcgtccagatctctgacttcgttccacagatcggtcagaagatgcacacagtcacaggctcgggtatcgttgacaacgtggtcgcgcaggaaggcgcaaaccagtacatgatcaccctgaagaacgtttcaggcatcatgacggcgagccaggtctacacatgcgacgttctcgtcaaggctgttcgcgactggcacctcgtgtcgtctatctcgactcagaagccgcagtcgtacacactcaaccagtgcacaggtacagttctccagaacaactacggaacgaagtacccactcggtacaatcgcaggcatcccgatcagcgagttcaacagcgaacacgcgacaggttcacagggtcacagcgtcatcgccgtcgactcgattgacacctacgtgatcaacgtgcagacacctgcgacagcagctggtcgtttcggtggtgatgtcctcgcgtacaacggcaacgaaaagttcgaagtgttcaacgtttcgggtgcgtaccttccttaccgtgcaatcgaaaactggtcgttgactggtatcggacatggtacagtgggttcgatcttcgaaagcgcaaactaccgcgctcagacaccggtcccgttcgcacctcaggaagacaagttcctcggacagccatacaagatcgcgtcgaaggtcaacgagcagatcatgctcagcggcggcaagtcggtttcgattgcagctaacttcacgacatcgactgacatcagcagcccagtggtcaacctcgacacgttcagcctcacaacggtttcaaaccgtgttgagcagcagaacaaggcagctctcgaggcacagccaacaggcggcacgacatgggtcccagagcagaacttcgtcggcggtactgagaagtacaagtacgtcacgcgtacagtgaacctccagaacccagcgtctgatctccacatctaccttgacgtctacaaggacatcaacgccgatttcgacgtgtacatcaagcgtctgacaccggaagacagcggaagcatcgatgacaaggcatggatgaaggtttcggctctcacgaagaaccgctcaagcgttgacatgacggacttcattgagtatcacatcatcgcgtcggagcatgtcgttccttacacagagaacggcgaaaactacggcggttggttggatgaagacggtgaaatcgtttcgttcagttcgttcgctgtgaagttggtcggtaaggcaggtaactcggctaagccgcctctcttcaaggctcttcgaatcatcgcggtaacttaatatgcaagatgcaaaagtggaaagccatcccgacctaatacgtcggggtggtgcaatcgtcaacgtggacgacaaggagtactcgcgcgcattgcttcgccgcaagcaggcaatgcgtatcgacacgttggaaaagacagtgatcgaaatgcacgacacgatgactcagatggctgcaatgatcaaggagctccacgcacgtaaataagcttgaccttatttcaagtgggtgagccgtggctcctggacgcatcaattcaagacagcaactaaaagaatactgcctgcgcgcactcggtgcgcctgtcatcatgatcaacgtggacgacgagcagttagaagaccgcatcgatgatgccttagacttgttctgggagtatcacgctgacggttcgcacctcgtgtttctcaaccatcaagtcacgcaagatgacatcgatgggaagtacgtgacactgccggatggcgttatctcaatcgtcaacgttctgcacggcggctactcaggtggtctcggcggaagcaacggcattgcaggtatcaacttgcagtacgattcgtacatgacagacctcatgaacccgcgtcgcatcatgcaaggcggaatttcgtcttactacatcacgcaatcgtacctcggtatgatgggcgacacattcagtgcgccttctcgtctgacattcagcaagtacagtgatcgcctgacgcttcaaaacgactgggcgcgggtgcttcctggctcgtggatttcggttgaggcttacgtcgcgaatgatccgcacgtgatcgcatcaatgtggaatgatcgctggctcaagaagtacaccacagctctgttcaagatgcagtggggcagcaacctgatcaagttcgcaggtgcgcagcttccgggcggcatgacagtgaacgcggaacagattcacaatgatgcgaaggaagaagtcgcggcgctcgaagaggaattgaagaacgattaccaactgccggtggatatgttcatcggataactcggtaaatacttgaagaatccatagagaattaacagtggcgactaatcagtactttaacagaactgcgatgaaggcggaacaagacctgtttgaaagcagcgtcatcgaaatgatccaagtgaatggcgtggatgtctactacattcctcgcgaaattttcgagttggatccgatcctcaaagagccgaagaacactatcttcaagcgcaattttccgattgaagcgtacatgcccgatgccgcacagttcggtggtgagcagaacatcatgacgcagttcggattccgcatcaatcaaacgactgaattcgtgatcagcaagaagcgattcgcagaactcggcgttgaccgcttgcgcccgcgcgaaggtgatctcatctacgtgggtgacatcaatgacccacaggacagcttcatcaatcagatgttccagatcaatcaggtctggtacaacaatcccgattggcagtttggtcgtcacttcacctaccgcatcgtctgtgagtcgttcatcaactcatatgagaagttccagacaggcgctgtcggtttggatcagttccaagctgacaacagtgaggaagtgaagtcaggtatcaatgcggaagtgaaggaattctcggaatcattgattaagttcgacaccaacaacccattcagaagcttctaatgtcaagagcacctttctaccacgcaaccacgaaaaagattatcgtcgctttcgcaacgattttcgatgagctggtaatcaaagatgactggggtcgtgacctcacggtccctctcgcattcgctcagaaggaaaagttcattgatgacattcagaagggtgtcgaatatgacatggacggaggtggacaagcaatcgtgttccctcgtatgggattcgaaattgtaggtctcaacttcgcgcccgaacgtcatttgaacccgatgcagcagttgcttgatacgcaagaggacggacaagacgttctcatgtataaccgcattccgtatgacatcacgttcgacttgttcattggctgcaagcagcttgagcatggactgaaggtgatggaacaggtagttccgtttttcaatcctgagttgacagttacgatcaaggacaaggaagagtttcagctagaaacgaacatccccattaccttgaacagtgtatcactcaacatcgattatcagggttcacttgatcaatcacgcattatcctgttcacgcttaacttcacggcgaaagcgtattactacccagacattcgtaacaccaatcgaatcaagcagacgatcctcaatttccgtgagcaagactacgaccgtcaatttgaacgtttcacctcgactgtatcaccaatcacggcaggtaaatacgatgagcacgagataatcgatactcgtgagatcgtggaaaatgaataatgacagacgattatgttgatccaatcagcaaggcattaggcgcggcgacaccaatcggttcgctgccacgccctgtgagtgatgacaatttgcccgcgaagatcgaacaggagaacgaagagcctcgtgagatcgaagacgattatcaggaagcgagatccaatatcaaggagcttatcgcacagacgatggagcagattccggacctcattaacctgatggctcagtcgcagaacgacaaaatgatttcggcagtctcggggttcatcaagacggcgggcgatctcaacttgaatatgtctaagctttcaaaggacatcaagacgccgaagcatactaagaacggacctacgacacctacaggggttccggacgcgcctacgtcgaccaatatcgtatacgtgggaactacagaagagatcttgcgtaagattcgcgaagatagaaagaatcagccgcccgtagacgctgagtttgtcgaagttacatcagacgggcacgacagttaaggcggtcccaaccgtaagcgatatgtcacgcctcactcggctaagcctcgtggctcggtcttaactccgttaagccctcacataatccgtttcatttcctatacaacgtttcaaattctttacgatgccagaaccgccaggtacagttaggctatcaagacttaactgtaccaaactaggtaaatgagtaattgcaccgtttatcacgacgtggatgaccggaaacgccgtattaatgcaggttagtccctcgcgggatcatcgccaaaatcatcatcgcatactcactaaatgatgattcacacccgttgtcactgttcacagagcgggtctcttcgaacctttcgattcttgttcaagcataatgtcgcacgtacacacgcgtgatgcgtgtttcactgccctaaattcacgtcgcgaagcacaaagaaccgacgactagtcagtgacacattttcagtaaaggttacatgaataaataactaacgccaatagagttaccaaagtgtttctcaacttaatgatggcgcattattcaacggaacctatttatgagtgtcactgaagaacaagagctaaaccccgaacatttttacaacagtatctataacctgaagaaggcaggcgtcaaggtcgagctgactcaggaacagatcatggaactcgcgaagtgcgaggaagacattgagtacttcatctcccacttcgtcaaaatcacatccctcgacgcaggtacggtgctgttcaagccgcacgcgtatcagtcacgcgcgatcaagaaggcagtcgcaaaccgattcagcatctggaagtggcctcgtcagcaaggcaagacgacgacggtggctgcgatcctcttgtggtacgcaatcttcaacgaaaaattcgacatcgcgattgtggctcagcagaagggtcaggcggtcgaaattctagatcgtatccgcgaaatgtacgaaaacttgccatggtggatgcaacctggcgtattctcgtggaacaaaggttcgattcgactcggaaacaagacgaaggtcttcactgctgcgactggtggttccggtgtccgtggtaagtcgatcaatatcttgtactgtgacgagttcgcgtgggtacaagacgacgtgacgttctatacggcgacctacccagtggtctcgtcgggttcgacatctaagatcatcatcacttcgacgccgaacggcatgaacttgttctacaagctctggaccgaggcgacgacgggcaaaaatgcatacgtgtgggacgaatcgttctggtacgagcaccccgcgcgcgacgaagagtggaaggcgacgcagctccgaaacatggaccagcgccagttcgaccaagaattcgacaccaagttctacggttcgagtgacacgctcatctctggtaacaagctccagcagatgacgttcaaagaaccgatcaagattctcaacgacaaccgcgacttcaagatcttttctgatccgaagcctgatcgtagttacgcgatcaccgtggacgtctcggaaggtgtcggtaaggactactcggtcatgacagttatcgatgtcaccgaggctccattcgaacaggtcgcgatgatgcgcagtaacatcatgtctcctctcatcttggctgacctggtgaaccgttacggcatcgcatacaacaacgccgtggtgatcgttgaatcgaacacatacggcaaacagacagtggactcgctctggtacgactacgagtatgagaacatgctcatcactcaacagcaccaaagcgaatcgaaggttgcctcgggcggtcgcaaggctgcgcctggtgtcaagacgacgaagaagagcaagatgctcggctgttcatcgctcaagggtctcattgagtcgaatcagctcatcatccacgacttcgataccgtccaagaattgactaccttcgtcaagaagggtccgagttacgaagctgaaaagggcaagtacgacgacatcgcaatgtcacttgtgatcttcgcttggttcaccgcgcagccttacttccaggacatggtggacctcaatgttcgccagcttgtccgcgaaaacttgacgcagaacgaagagtattctaccgcgttcggattcatggatgacggactggacaacggtgatgaggatgtcagcgttgaattatttctatctcttcgtagaaattgaaacaataaataagaggcaaagactaatttcaaggtatccttgcctctctaggagtaacacaaatggcttcaacattcacacaaggcagcccaggtgttgatttctcggaaatcgacctaacaaaccttccaggtaccgttggtatctcgggtggtgcgtttgctggtagcttctcttggggtccggtgggcgaaatcactacggtatcgtctccactcgaactcgagcagagcttccacaagccaacagacaagaatttcgtcgactggttctcggcgttcaacttcctcgcatacacaaacgatctcaagatttcgcgtgctatcgatgaggcgagcgcactcaactcagacgacacaggttcgggtatcctgatcaagaaccgtcagcacttcgaaattgtgagcacgtcgccaacggcggtcaagttcgcagcgaagtatcctggcgctctcggtaattcgattgcagttcacatggctgacgcagcgacattcgctggttgggcatacgcaaacacgttcgaaagtgctccaggcacatcgacagccgctcgcctcgttggttcgaagaacgacgaagtgcacgtggtcgtggtagacgcacaaggtctcttctcaggtactgtcggtgcgatcctcgaatcgtacgcgttcctctcgaagtcgactgactcgcgcgacgagaacaacgcacctaactactacgcaaacgtgatcaaccgcacgtcgcgttacgtttgggctctttctgctcctacgggcgcggacgtggtcgactcgtcaacgggcaaggtttcggcagttgcgatcactgatggtggtgaagactacacatcggcaacagtcacattctcacttccgggtgcaggtggcgttcgcgcaactggtaccgtgcagctcgctgcaggtgaagtgacaggcatcacgatcacgaacccaggttctggttacacatcggcacctacagtcacaatcgcaggtaacggtactggtgctgtcgcatcggcatcgcttgaggcggacacggattctgcagaatggggcgtctcgtacgtcgtccagggcgttccttcggtctacaagagccttgcagagcgcatggaagtcacactcacgggtggtacggaaggcgcgactgtcacatcgggcgacctcatccaggcttacgacttgttcgaaaaccaggaagaagtagacgtttcgctcatcttcctcggtcatgccggtggtgaagcgaatcacactgcagttgtccagcacgttatcgacaacatcgcagaagcacgtcgcgacgcaatcgcgttcttcagcccgaacctcagcgacatcttgaacaagacacagtcgcaggcaactgttgacgcaatcgcgacacgtaacgagattggtcgttcgacatcgtacgcagtaatggacgatggttggaagctccagtacgacgtctacaacgacaagtaccgttgggttccgttgaatgctgacatcgcaggtctctgcgcgcaggtagacaacaccaacgatccatggacatcacctggtggttacacacgcggtcgcttgaagaacgttgtttcgcttgcgttcaacccaaacaagacatcgcgcgatgcattgttcaaggcgggtatcaacctcatcgtcactttcaacacagatggtacagtgttgtacagcgacaagacgttgctcggcaagaactcagcgttcagtcagatcggtacacgccgtctgttcatcacgctgcagaagagcatcacatcgcaggcacgtttctacctcttcgagaacaacaacgagttcacgcgcgcaagcttccgtaactcggttgagccatacctccagcaggtcttgggtcgtggcggtatcgaagcgttccgcgtcatctgcgacgagtcgaacaacggtcctcaggtccgcatgaatcgtcagttcgtcggtgacatcttcatcaagccaacgtactcaatcaactggatcaagttgaacttcgtcgcagtccgccaggatgtcgcgttcgaagaagtggtcggcgcaacgttctaataagttcaaacagttggtaacactttggacccgccgcaaggcgggttctttttatctgtaaatacattcgatattcttctattaaggttgagtccagggaagagatcgcccaaaacaacacaaaactctggagttaaacacaatggcagcggacatctattcgttcctagcaaactttcaaggtggcggtcagcgtcctaaccgttaccgcgtaaacatcacgttccctaactcggttcctggtgcgacacgtgcgtctgagaagatcagcttcacttgctcggcagcagcaattcctggttcgacactcggcgtcatcgacgttccgttcatgggtcgtcaggtcaaggttcccggcgacaagatttgggaagactggaacatccaggtccttctcgatacggacttcgttggacgtgcagcgttcgaaacatggcaggatcgtctgctcggtttccgtacgaacctcgcgcaggcagagaacctcaacccaatcggtaccttcgggcgtgcgacagtcgatctcctcgaccgtgcagatcaggtcacaaaccgttaccaggtcgatgcgatcttcccaacgatgatcggcgaaattcagctcggttacgatcagaacgaccaggtcgcattgcagcctgtcacgttcgcgatcaacggctggtcttcaaacgcaacacctaactaatcactatgacaatatgacccactcctctgcgaaagtacgagtgggttctctttctgtgcgtaaatattggtaattcacacgagaatgtaaatggaaatcctcggctatgacatcaagaaggtacccgacaagcgcgatctagaatcgttcgcgattgatcgcgagttgacatcggaacgcttgatcccagagtcgagctatggcactctcgctggcatcaatagtgtaccttacgagttgctccagactccaactgaagagctgcaactcatcaagaattaccgcgaactcgctgcctcggctgaggttgacgaggcgctgcaagaaatccgaaacgaaattttcgtctttgaagacggcaagaaggcgttcgaactcgacttccaagagtcgactaagatttcgaagcctatccggaacaagatcgttgactgtttcaacgaactgtaccacatcattgactttgacacctacggttctcagtacttcgacgactggtatgtcgattcgaagttgtacctgtacaaagtgatcgaccagaagcagccgaagaagggcattcagaaggtccagttcatcgacccattgaagattcgtctcgtgcgcgtgatgccgaagcctgaaaaggacggcacatacaatgcagcactcatcgaagagttcttcgtctacggcaacagttacgcggcggatcaatcatcgcctttgagtcagccgatcacgctgcagtacggtcagtcttacgcgggatacaagatcaatcctgacgcggtgacctacatcaactcgggtttctttgaccgatcactgggtctgtacactggttacctgaagaaggcaatcgtcccttacaacatgctcaagatgatggaagacgcaatgctgatcttccgcgtcgtgcgcgcgcccgcgcgtagagcgttctacgttgacgtttcgggtctgcagaagaacaaagcagaagcgtacatgaaggatcttcagtcgaaactgaagaacaagatgacctacgacaccaagacgggtacgctcgctgatcgtcgtaacatcctctcgatgcaagaagactactggctcccacgtcgtgacggtggaaagggaaccgaagttgcgacgattgaaggtcagtcatcgcaagacatcatggacgagatcgagtacctgcgcgaccgtttgtggcgttcgctcaacgttccgcgtggacgtttcggtgagaatcaaactgtcggcatcttcgggcgcggaacagagattcagcgagacgagtaccgtttcactaagttcttgcaaactctccgcaacaagttcatgccagcgattgaggatttgctcaagtcgcagttgcttctcaagcgcatcattgccgtagaagactgggacgaagtccgccgcgcgatcaagtgggtgttcaccgaggacaacacgttcgttgagaacaaagagcttgaactcctcatgtcacgactcaatgtcttaaatatgattaaagaccattcgggtacgtactactcggatgattggatcaagcgcaacgtcctcaagcagtccgacaaggaaatcgcttccgaagagaagaagatggaagaggaacgtaagaagcgtcaagaattgggcattccagaaccgggcgcaggcggtaacggcttcgatccaaatcttgatcaaggtaacggcggtttcggtgacgacgatcaaggcggcgcagcattcaatggcgctcctgcagaggatccaaacaacccattcaagaatcacggcggtaatgatccgggaacggacactccacctaatccattcgacaaagattaaaggacagcatcaatgagcgcatacacgttcgtcagcgatatgaagaagcacctggacgcgcgtctacagcagcgtcttgaagaaggtgctgccttcgacctgttgccggaacgacttgaagagtcgaagggcaagaagaacaaagagacattcctcaagacgtcagtgaaggcgtacgaagatgacttccgtgacgcatcgaaggatgacgacaaggaaatctcctcgcgcgcgaagaaggcgctcaagggcgttgaaaagctgaagagcatcaatgaggacaagttcgaaggtggcgtgcctgcacgttacgaggattatctcgcgaatcagttcgcttacatcttcatgcaccagcgtcaggagccaacactccgcgaagacatcgatgagtctttgaatgaggacatcaatgttctcaatgacgaaatcgtggtcgattggtcgtcaatgaatgacctcgagaaggacgcagttgtcacgttgaaggaactcgggcgtcagctcggttcagacgtcggtgcatactcgggcggcgttcttcgcctcacgttcggtaagaaggatgccgtgcagcacttcaccgacgaactcgaaaatcaggacttcgttgactcgtatgagatcgaagcccacaaggaaggcgttacatcggacgaagaagaagtcgatttcgacactgtagtgttcgatgagggttatgacttcgacgtgtacgtctacctctatccggaaatcgtaagcgaaccagatttcgaatacgaagccgaaggtgacgagcagtttgatgagaacacaaacgttgaattcttgcaggaagtccgtcgccgtatcaaggtgaacttccgtggtaagcgccgcgtcaagatgcagtgccgtcctggattcaagtgggacccatcgaagcgctcttgcatcaagatcacaggtcgcgatgttgcgatcaagcgcaaggcgatgcgcaagatggtccgcacgaagaagtcgaagggcacatcgttccgcacacgcgtactccgcaagacacgtaaggcgaagcgtttccgtaagtcaatgggactcaagtaatgaaatttgaagaatttttaattgaaggaaaatttgccgccagctcagtagatggtgtgcgcaagctcttcaaaactgcagaggaagcaaaagcttggaaagaaactgtagcaaagccacagaagccaggaaaagtttcgtcggtccctgatttgaggaaggtttctcaaatcatccaaaccgaagtgggtaatcacttccccgattcggatggcttcgatgctatcagtaagaaaattcgaaatatgtatccgaatctttcacggtacgatgtcatgcctttgctcgataaagctacaaagaaagaactaggatcaaaggatttccacgcatatttggatgatatgcacaaacagcattcgagtgacaagtaatgagttcccgctcagagtggtccgccaatcaagggcagcacaaaactgaggaagagaagaagcgcgagcacgtcaatgcgatggctcgcgaggctttgaagaagcacaaagagaagaagaaaccgtcaatcgggcaacgcatcaagagcgttttcactttcgagcagtacattgccgaacgcgcaacacttgacagcgtacagaagcagctcgctgagatcgacaagaagatttcagctggtggaggaacacccgacatcatgacacaacgaaacaagctgtggaacgcacttcgtgctgttgcatgggttcgtcctcgtagtgatcgcgatgatgacgacaacgataacgaagatgccggtgacggcggagatggtggcggcgaatgacatttgaagagtacctaggcgaggcaatcaagggctggaagcacgctcaccgtgacctcgcgaagatccgtagcaatgcagcatcggaaggacgtcacttcatccttcatcagttgaagaaagacggcaagacagaaagcaaaatgcatgacgcgcgcacgacgtacgcgtcagaacaggaagcccgcgataaggcaatgctttggcagaaactcaacccagatcgcggacttaagtacaacctatacgacggcgggcgactgctcggagttatttgaggaaccacaatgcacgttctagtagaaagaaatgacgatgttcgcaatgagatcctcgtcgaggatgttggtggcaagccaactaaaaagtacatcattgagggtatctgcatccaggcggaagtaaagaaccgcaacgggcgtgtgtacccaaagaagctcatcactcctgaaatcgatcgcttcatcaaggaagacattgccttgggtcgcgcggttggtcacttgaaccaccctgcagaagatccacgcaacgattacaaggaagtgtcacacaagttcacgcacctctatgaggacggcaacaactggatcggtaaggctgtcgtcacgacgggcacgccgaacggtaagatcgttgcaggtctcatggacgaaggcgtcaacatgggtatcagcacgcgcgcacttggcaagacaaagttgttcgaagagcgcggtcagcaggtccgtgttgtccagagcttccgactcatctcaccgggcgacatcgtttccgatccgtctgcgcctgacgcatacctcaccaatctcatggagagcaaggagtgggtctggcaggacggcttgctcgtagagcgcgaggcgcaggtcaaggaagaagtgaacaaggctgttcgcgaaggtaagcttgatcaggcgaagatggttgagttgttcgaaaagttcatcaagatgagcacacagtctgcacctaagaagatgaatgtcgataaggcgaatgcgcgcggcgtaggacctttccacatgttcaagggcaacgagtacgtttcatcgcatcgcggttacgaaagcacaatcgaactcgcgaagaaggaagggcgctgggtctacaacgacagcggcgacctcgtatttgacggcaagaaggtgatcaaatgatgacattcgaagagtacctaaaagagaatcaaggtgcatcggtttcacagatggctgcgatgatcaagaagcactatacagctgcaaaggtcaaggggtcaaaggtcactttcactacagcggattctccatcagatgttcgtaaggcgatcaagactgcattgccgggtgtatggcatcagtcgagccgcaagatgcctggtgaagatattgaattctacaagccttacgaggacggtcacaaggcggtcgtgacgttcaaaggcggaagcgtaaccgttgaactcgaagacggcatggttgaagattaaaatctcaaaccaataaataacaacgaaacatttaacagcattcagcgagactcaggagtttaagtaatgaatgacgaaatcaaggcacttctggaggaactaaaccttcctgaagagactgctacacagatcacagcgatgctctctgaggctttcgagaaggctaaggaagacggcaaggctgaaggtaaggaagaagctgacgccgaaaaggacgacaagatcgaagccatgaaggaagagatcgaacagctccaagaggctgcagaacgtaacgaagcgcatctcatggagaaggcgaacgagtacggcgcacacctcatggctaaggctaacgagtacggcgaactcatcaaggaaagtgcatcggcagctgcgcaggaatatgctgactatgcaatcgaagagttcatcacggagaacaaggaacgctttgtccagacggaagacttcgcacgcatcaactcggcattcgagatgatcaaggaatctttcgaagcaaatggtttcattgtaaatacagatgcacgcgtagacgaagcgaacaaggcactcacggaagcgactgaaaagttcgacaacgtgtttgctcagctcaaggaagcacgtagcactattgagacgctccagcgcgaagcgattttcgaatcgaagactgctgagttggcggacacacagaaggaaaaggtcaagagcctgatcgagaacgtgtcgttcgataccaacgatgagtactcagaaggtctctctatgtttgttgagcaggtctcggcacacaaggaagatcagactcaggagctcctcaaggagaattccgatgtcgtggcacctaagtctgaaacagcctcacgctggattggtcgcggtctgctctaatcacagaaatatcagaaacataaataccttagagttttaaactaaacattaattttgagagatcaggagaaaacaatgtctcaagaacaagtaacagaaaccctcctagagaagtgggagccagttcttgaaagcgaaaaggcagatcctatcaaggacccatatcgccgtaaggttactgcaaagcttctggagaatacagaagagtacctcaaggaagcttcgaacctcacagctggcgtccagaactgggaccctgtcctgatctcgatggtccgtcgtatggctccgaagttgatcgcctatgacatcatgggtgttcagccgatgtcggctccaacaggtctcctgttcgccctccgcgctcaccgcgcacagactccgccaaacggtaacccgcagggtggtgctgaaatccttggtctccacgaagctgatacttcgtactcaggtacaggtacgcacgttggtaccgatccgttccatcctgactactcgactggttacggtaagtcgacagcggctggtgaagttgatccatggaacagcgtcggtgtgacaatcgacaaggtccaggtgcaggcaacgactcgtcagctccgtgctgattactcgattgaacttgcgcaggacatgaagcgcgttcatggtctcgacgcagacgcagaactcgtcaacatcatgtcgactgagttgatttcggaactcaaccgccaggctgttcgtacggtttaccaggctgctgaactcggtgctgcattcggttcgacaccaggtacattcgacttgaacgcagacgcagacggtcgttggtctgttgaacgcttcaagggtctgttgttcgccatcgagcgtgacgcaaaccaggtcgcgatccgcagccgtcgtggtaaggctaacttcttgatcgtctcgtcagacgtggcttcggctctcgcaatggcaggcatcttggactacgctccagccctcgcaagcacgatcaacctcgaagttgatgcaacaggcgcaacgtacgttggtaacgccggtcgcttcaaggtctacgttgacccatacctcggtgtggacgcgtacctcgcaggcttcaagggtgcgacacagtacgacgctggtatctactacgcgccttacattccgttggaactccaccgcgctacggacccaacaaacttccacgctgcattgggcttcaagacacgcttcgcgttcgctgagaacccattcgtcggcaacagccagaacatcaaggctggttcaaacttctactaccgcaaggcgaaggtcacaaacctcatgtaatagaagcggaagtccgctacacgaatcgccccggcatgtccggggcttttctttgcctggcatttgaggcttgacaatcctcaaagactttgacatgatgacggtaagacattgaggaacgcacaaatgcgccgtacccgcgaaacgcccgtgaacaaagttgatgcagccctgaccgtcaagatccgcgaaatctatgcggaactgaccgaagtcgccgcacctcatatcgtcggcagaacgcaacgtcccatgacggttccgctgcacaagatgaaggtgtactgtgtcgatcagcgtcgcgggcgtgcgtactacaataagggcgggttccgcatcatcacggttccgaaatgggtgtttgctcgtggcgaaacctacgttcagtggtacgtcgcgcacgaaatggctcatcactatacgcattcgttcgccggtcctgctgcacctccgcacggtcaaatcttcatgtcgtggctcaagcgcatctgtccggaaaacgcgattcatcatgaactcgggtacaagcctcgcaatgcgtctcgcgcgggaatccgtcgtcctgcggcagtaactgcctgattctaaacgaggttgcaatacctcaaaatttctgtatactttgatcatcgaatcacggcacggaatcacgatcatgaccgttacgaagttcacctggaatgatggcactgtcagtctgtatgatcgtcgcaacggttgcggcgacagtttcaaggtcaagcctgacggctctgtgatccaaatcttctacaatacgatgacgcgccgctacaagtacaagcgcatcacgacgaagaagggtcttgcgcacatcgccgctctgctcgaaatcgcggaagagcgtaacccgcaggttgccgcatgaaacgccgcatctatcgtctcgaatcttcgatctcgcgcaagggaccgtaccacacatggtcccctgaggaaggtccgccgtttgatacggggtgcctgaaaaggcacgacgttccgcaacgcaacggctggtgcttgatcatgggtgggcgccggtgtgcatggggttcgcgcatgaagatgtttgaatttccggcatctgttgccgaattcattgatcacgattcgtgctggaagattctcgaactcgaaatcgatgaatcgttgtgcgaagtttgcgatgatgaacaagtcgtgttcaatcacgaagatgcgatcacggtgcgcacgttcgaacttcaagagttcttctcgcagccctacgaattttaccaggagtgatgcaatgggttactattacgacggtaccatccgctgcttcacgccggacaatactgcaagtgaactgtacatcgattgcgattggggttatattgcattcgatcagattctgtccgatgcgcgtacgcatttcggcaacccggaacttcgatttgaagatctggagatttccgcagagcacatcaatactcgctgcatcgggtatgatcgatacgacaacttcgattacaccaactacctcgtcatccgtcataggggctgatcatggagcttttcgtcaaagaggcacgcgggcgttatcgtctcgcaacggcggaagaagccttgcagggcgctgaggcatgcatccgcgaaaagttcacgcgcacgggagagtttttcaccaactcgacatatacgcggaacgcgttcaagatgcgcctcgcgctactcgaccgcgaagtgttcgccgtcgcattcctgacgacgaagaatgaactgatcgaaattcgtgatctgttctacggcaccatcgacagcgcggaaattcacccgcgtgagatcgcaaaggttgcactcgaactgaatgcagcggctgtcatcctcgcacacaatcatccttccggatcggcgtatgcgtcggcggctgacatcacgatcaccaagaagatcaaggctgcactcgatctgatcgacgtgcgcgtggtcgatcatatcatcgtcgccggaaacctgacggtctcgatggcaactgaagggctcatgtaatgaagttcgaaagcaaaaatctgatcctcggttccgcactccgcaccatcatgggtccgattccgccgaatccgaaggtgatccgcaagatcccgaagaagcagggcggcgactggaacatcaaggtgagcgacgacaagctgcgcgatgcgctgtaccggcacctgcgcggcgaacataagaagcatctcgccgatgaactcggcgtcacgatggctcagttcaccaagtgggttgacggtgagtcgcgcggcaagatcctgcgcgaagccgaagagctgctggaacaacacgcgagggagtacgcatgaaaaagcgaccacgcgcggtgatccggcaagagatccatgaactctatactgcgattcagcacggcgttgttcgcggtgacggcatcgcataccgcacacctgaactcgtcaccatcgatgatgcgcgtctccgcctcgcagcactgttgacggaagacccgaaagccaagcccaagtggatggattgaacatgactaagagcacaccatacgaactaccggaagacttcgaaggcggcgagccgctgatcccacccggctggaacccgctgctgtggttcgccgacgacctcggcgctgaccctgcgagtctgccgcagtacggttctatcgttgcgatcctgtgcgacatgcgtttggtgccgcacgatgcgcgcatcgcggatatgatgaacaagaagccgctcgagttgccgaagaccggaaacgtgatcgaaggaatcatccacagtctgttcactcaacgtcagcgcattcgcgaagtttttcttgcgcggtatctcggacccgattcggacggtcacccgatctttgaaaacgtcggaaacggaagtgaccgcgcacacgactcattcttaaccgccacgtcgcgcagcaacatcgtcgcatggcaaaaggttgacatcccgtacctccctgatgtcgaaatctgacgggtaaacttgcgaagaattcgaggttgacaatctttgaaatctctgtagaatgtcaatcatcggaaacaaacacggaacacgcaacaatgtacttcgaaccgcatcaaaagcctgatctcgtcacgttcgaaaacgacgacaagggaccggtggtcgttgagacctacggcatgatgcagaaagtgtactggggcagcggcaatgcagcctattacacgcgcggcactccggaatattgggcgcgcgagtacgcaatgtccggtgatcccgatccctaccgttacatcgaccttcgcaactttgaccccgccgaactggaccgcgtcctcggcatctccaaggagtaatgatcatggcaaatgcacccaagaaggctgtccgcatcccgaagaagctggctgacgtgatggacacctatttccagacttcgcagttcgcgcagaagcacttcctcaagttcaacaaggaaaatctgctgaaccagattcaggagcgcgccgcacggtacggctacgaactcgacatcgatcacgcaacgtcggacaagttcaagggcgtgttcaagctcgcgcacgcgaagcgcgacattcgcatcagccgcagcaccctgcccctcgccgaagactggtccgcaccgaagggcaagtgaacattttcctgacaaacagtgacccgcaaatctgcgcgcaagagcttgatgacaagcgcgtaaacaagatgttgctggaaactgcacagctcttgtcaagtgcgcataggctgaagggcggaagctcttcagtctatcgtcttacacataagaatcatccgtgcgcgatctgggctcgcgaatcgcgagagaactatctctggctctacgaatactttcgctgcctctgcgaggagtacacgttccgtcgaggtcgtgtgcatctgtctgaacagaagctgctcgcgatcctcgccgacgtaccaccggacatcacggcacatgaccgtactcccttcgtaaattgttcattgcgcaaagaccttccccttttcgaggcgtaccgcgaaacgatgcgcacaaagtggaagactgacaagcgcgctccgacatggacgatgagagacgaaccagtatggaagtccgattgaacgaaaacgagtattcgattggaatatggtcaagggctccagacgacgcagttgcctgcgtcgtttctgctaatggcctactcgaatggtggaaagctgttccgcgtgcatcacgcgcgggcacgcattgggtagattcgattggtggtgatgacaccacggcgcatctgatcggcattcaatggctcgacggcatcggacccttaagaatctcgtggtggcggaattcgctttgtatccgccctgcacgcgcgaatgtagtaaaatcaagtagttagcgaggaccccttcgttgacttttccttagtaaaatcaggcagttaccgtttttagcttgaaaagctgacgtttgccttgatgatgacgcacatggagcgatcatgacaattccggcacacatgcagttctctaccctcgacctcgaaacagcactgtccctgtacggcaaagacctgccaccgggatggagcaataaactcgaggaaatctgcaactggatgcatcaagagaacgaggagatcgagcggttggaggagcggattcaagacctcgactccgacgtggaggacctcacgaaatttcgaaatgaaacagaggactacctcaacggcatcacacaaacagacgacccgctgacgatcaagcaagaactcactgaaattttggacatgtacggctacactctttcgcgaggacgatactaatgacgccagaacaaacagactgcatcgcgcaatatctccgtgacaatctgcgcatcaatgtcgcgatgactgatcgattggacttctacagccatggtgtcagggttgaagttgacatcatacttggtgacgaggtgatcgcgtcgtcttccgactacatcacgacatcatcggattactgatcccgtttcactgatcaattgcagcaacatctagagctctatagccttgacgaaaattgaggctatggagcttttctatgagtgaaacaaaaagattgatcggaattacgggtgcagctggtgcagggaaggacacggtgaagattcttctcaaagaaaccatgtaccctgagttgagcacgtattcgttcgcgtcacccatctacgatacagtgatgaacttgtttggctggacgattgaacagctccaagaccgcgagtttaaagagacagtcgatccgaagtggggtttcagtcctcgccgcgcaatgcagctcttaggaaccgagtttggacgcgaactccgcgaagacatttggattcacttcgcgcgcgtgttgcttgactcaccgttcaattccggcttgatcgtctcagacgttcgattcgaaaatgaggcagcattcatccgtgagaacggtggtacgctcctgcacatcgttcgcccctacaatccgaacgcgattgcagcaacacacgcaagtgaaggtggtgtgcagtttgtcgaaggtacagatcacctgatcatcaatgacggcacgctggaagacctgctgcacaagttggaaaccgcctttaaatacaaggaattccaacctcagttcaattgacatggcagcaaagcgacagaactacaacccggcgttaccaaccagttacctcctgcgcattccggggttcgatcacgtcaactacaccattcaatccgccgcccttcctgggttgacgatgggtggtgtagatgcaccgtatcagaactaccagacgaacgttccgagcaatagaatcgaattcgacccgctcaacctgcaattcctcgtggatgaagagttccgcaactacgaggaaatctatgcgtggatggttcgcacgactcagacagaaccgatcatgcgcgacgggttgaagaatctctcactgcacatcctcaattcgaacaagcagccgatcatcgaagtgaagttccaccaggcatatccgacgatggtgactgaaatttcgtttgaatcgggtgttacagagccatcaccgatggtctgtaccgcaacattccgataccaatttttcgaaatcatccgaggcagcaaatgaaatttgagacattcctagaagacatcccgaagcgtcctgcagctggtaaaggtgcaaaactcagcggcaagacgttgaagcgcgaacacagctctatgtactggtacctgtgggatggttggtcgttcgacattcgatccatccgcaagcgtctcggtttgccggaagaagactccagcttagatacctacggtgaaggcgatacacctgccgaacaggcgaagttgtcagatgcacgcatcgcaaaggtcgcgaaggcgattgaatctaagttgaagggtcgcacgttcctctcgattcttgaatcataatacaagattaaccatcccttgtaactaaacgtcaaacccattagtatcgactgatcctagtgggtttaactgtgggcgagacataatatgaagttagaagatattcaagccgaaatcgagaaagattcgatcatcgacagcaacaagttggacacggagtcgctcaagattccgcagatgcacgcgaagtattaccgatatttcatggatgaagtgaaaatcctcaagggcgtggaattcaagttccgcgagttgaagaaggagaaaacacagtattatctcggtcaaggaaccgatgataaatacaaagaaaaaccgttaggcttgaaggtattgaaacaggatattgacctgtaccttgacgcggaccaggagttgaatgaactccgcgcccgttttgaacttcagaaagcaaaggtagacatgctggaaggattcatcaagaccttgaatacgagaaattttctcatcaaaaatgccatcgagtggcaacgattcaaacaaggtatgtaatgactgacattatccttcactacaagaacgaactcatgatgcgagtcgagtgctcgccttcaaccgcctacgaaatgtcggaggcgttctcattcttcgtgaacggatacaagttcatgcctgcattcaaggcaggtcgctgggacggaaaaatccggctgttcaacatcaaggatcgccagttctacatcggactggttgaggatttgaaggtctggtgcaaagagaacggatacacgctgggctttgccgaaggtgaaaacttcatgcagtctgacctcgcattgggcgaaggcgactgggagaagatcaagtcatacggcaagtttgaaccgaagtggtatcaggaaaacgcgatcaagtacgcgtgtgagtcggcaaagtcgctcatcctgtcacctacgggttccggtaaatcgtacatcctctacctcatggtccgccacatcttgacgcgtctcgacggtgatatcttgatcgtcgtcccgtcaacatcactggttgaacagctcatggctgacttcaaggattatgtcgctgacgattgggatgcgaacgaattcgtccacctcctctacggcggcaaggacaagagtgcgatcaagcgcgtcaccatctgcacgtggcagactgcgaagggcatgcctgccgcatggttcaagcgtttccaagcgtacctgtgcgacgaagcacacgaagccgattcgaagtgtcagagtgagatcatcacgaagatcgcgcacgcgcccgtgcgcatgggtctgacgggtacgctcgacggaacggcaatgcacctcctcgaaatgaaggcacgtttcggtgcagtgttccgcgcagcgacgacgaaagacttgcaggatggcggcgacctttcgaagctgcgcattgactgtttgcacctcaagtacaccaaggaagagatcgacatggtacgccatctggattaccagggtgagatcgatttcatcgtgtcgcacaagaagcgtaacttcctcctcgcgcaggctgcgttgaagagcgacggaaacgtgctcatgctcttcaactacgttgagcgtcacggtcaagttctgtacgacctactgcaaccactcgcagagaagcacggcaagaaagtctacttcatctcgggcaaggtggacgtcgatgagcgcgaagagatcagaatgatcctcgaaagggaatcgaactgcatcttgctcgcatcgtacggcacgacgaagcgtggtattaacttcaagaacctcgacaacttgatcttctgtcatccgtacaaggcagttatcacgattcttcagtctattggtcgcgcgttgcgagtttcaactgtcaaagaatatgcgacacttattgatgtcgcggacgatctgacacatactaagcgcagtggtggaaagattcaaaacaccacactgaaacatttccttgaacgtttgaaagtttatgtgagtgaaggatggaaatacaaaatcattccgatcaaaatgtaacatcgcagatgtccgatgaggacatcaatcggctgctgaaggcagatcctaacgcagcctatccaatcagaatgctacacctttctacgggttcattgatcgttggttttgtcatctcggtcctccctgacacagttatgatgctccgccctcatgttctccaggttgcaggtgaacggaatgatgaaggtgagttcaacattgcgttctatgacatgacaccgtacctcaatcagttggttgagtacgatccagatgagcttgatgcaacgccgttcatgacatcgaacattatcagcatcaacattcccgcgccgcacgtgagacgaaactacacgtctatcacacagatgaagcaacaatataactcggaaaaaggtgaagacgattccgtcatgccccgagactatccttcaaaggatacattacactgaggtaaattatgacaggcacagccagtaactattatgtcgataagcaacagctctacgaatcactctgcgattggaaaaaccagtgtgatctcgcagaacaaaacaaccttccgaagccgaaactccccgattatgtcggacaggtgattatcgacatttgcgaaggcacagcgcgccgcgcgaacttccgcaactacacgtggaaggaagagatgattggcgacggcattatcgccgcagtcaaagcgatgaacaagtttgacccatatcgcctcggcaaagacggcaaggttaatccgttcgggttcattggcttgtgcgtcacgcgcgcgtttatcaatcgaatcacgaaagagaaagatcagcacgcgcgcaaggtcaaggcgatgctcgatccaagcactgatagcttcacgacgcttgacggtgacgaaagtgattactccgagttgaacgacaagagcgatctctcagatttctattatggcagcaaggtgtactgatgaagtgtgcgattattaccgaccagcattttggtgttcgaaattccagccgtttctttctggataattaccagaaattctacgacgagattttctttccggaactgatcgcgcgagacatcaagacgctctggattctcggcgacacttgggagaatcgcaccaacctcaacatcgttgctttccatcgcgcgcgcgagatgttcttcgaccgactcgaagagctgggcgtcaaagtctacatgatcatgggcaaccatgacgtgtattttcgcagcacgaacgagtacaatgccgtcgaattcttggctaagatgtacaagaatatccatgtcatctacgatcacgaaacgattgtgtttgatggtttgccggtcaacttcctgtcgtgggtcaacaatgcgaacctagaggacagcctcaagttcatcgaaacctgcccacctacagtcatgtgcggtcacttcgaaatcaaatcgttcgaaatgatcaagggtcaggtgtgtgagcacggcttcgacaagtcgatcttcgaccgattccagaaggtatactcaggtcacttccacacgatttcgactgacgggcgcatcttctacatttcgaatccttcgcagacaaactggtcagactacaacctagacaagggtttccgcatcttcgacaccggcacactcgacctcgatttcatcccgaatccgttcgatgtctacgccaagatcgcgtacgaagatcaagagacagacattgtttcgttcgactacgaagagtaccgcgacaaaatcgtgcgcgttttcattcgatcattcgggcgtctcaaccacaacaagttcaatcttttcattgagaaattgaatgcagtcgcctacagcgctgacgttgtggagattgacgagacgagcatcgtcaacgaggaaggcgagatcgagtacatggataatcacgaactcatcaacaactttatcgatgacgtgatccaaaatccgaacttagataagtctctgcttaagacaatgttcttcgacatgtataatgaggctcaacagtcaacagataatgagtgacggagttaccaagacttgattcatttcaaaacagtgcgttggaagaacgctttaagttacggcaacacatggtctgaagtacagctggaccgcaatccgtcaactatcatcgtgggtaaaaacggctacggcaagagcgctattatggacgttcttgtctttggcctttttggcaagccctatcgtaagatcaagaaagagcatctgattaacctgaagaatggcaaagacctcgtggtcgaagtcaatttttcgattaactcggatgattatctgatccgtcgcggcatcaagccgaatatcttcgaaatctacaagaacggcaccctgatcaatcaggacgcgtcgtcgcgcgattatcagaagtatcttgaggcgaatatcctcagcatggattatcattcggcatgtcagattgtgtttgtcggtaaggcacagcacacgacattcatgcagttgaatccaggtgagcgacgccgcttcgttgagattatcctcaacttgatcgtgttcagtacgatggcgaagctgcacagtaccaagatgtccgagttgaagaatcgaatccaagacatcaagaatgcgatcactgtaaccggcgagaagattcgcattcgcaagaagtacattagcgacctcgagtcggatcagtcgcgcaatcacgaggctgaactcgagcgaattcgcgcgaacatcgcatcctacacggaagagctgcgcacgctcgaggttgagaaggcatcgattgaacaggtcgcatcggttgacaagactgagtatcgcaacctcatgacgaagttgagcaagaacgttgaaacgctcgcgcgtatcaatgcggcactgactgacatcgaccgcaagatcaagacgctctcgacatcgaccaactgttacgcgtgcgaccgcccgttggaagagcacgatcacgagaagaagcttctgcacgagcaggcgaagcgtgagcaagctgtaactgccgtcactgagttggatgagacgattgcagacctccgcgcaaccatcgaagatttcgaagacgcgatcaacaagtacgattcgtacattgagtctgtccgagacattgacgtgcagatcaacagtgtgaatcgttcgattgagacgtggactgccgcactcaacgaagatcgcggcacctcggacacgacggcgaagatcgcaagtgaacgtgctgagttggtgaagatcgaggagctctacaacaacctcgaggcgaagctggatgagttgatccagaagtcagagtactactctatgatcggttcgatcttgcaggacaagggcatcaagtccatgctgatcaagaagtttatcccgatcatcaatcaccaagtgaacgcgcacctcgcacagctgggtctattcgtcaatttccatctggacgaaaacttcgatgaaacgatcatggcacgaggcttcgataagctcggctacaacagtttcagtgaaggtgagaagcttcgaatggacatggcgatgttgctcgcgtggcgcgaagtcgcgaagatgcaaggtaatgtctcgacaaaccttctgatcttcgatgaaattttcgacagttcgcttgacgtgggtggtgcagaatctcttgccgatcttctaacatacacggaaaacctcaacgttttcattatcacgcacacaccggaaaagatcgcagataaagtacgttcgatcatgaaggttgagaaaattgacggattcagcgtcttgaaataagacgcgtcatcgattgggttaagtcaggtgacccattataatcatctgcatcagttacgttaaccattagtgaataggagttacacattatgaaattgtcagacagcacacgcgatcagttgaagaatttcgcgtcgatcaaccagggtatcgtcttcaaggcaggcaacaagctgcgtacgatttcgattctgaagaacgttttcgcgacggcagaaatctccgacacgattccgcgcgatttcgcgatctatgacctcaacgagttcctctcgacactgagcctcttcggttcggacgctgaaatcgagtacaaggatgatcatatcctcatctcgagcggcaagtcgaagatcaagtattactactcgtcgccgacagttgttgtgcagccgggtgagaacgatccgcagatgaccgatccagagctggagttcacgctcacgatttcggacctcaatcagattcagaaggctgcggctgcgctgaagttgaaggagctccaaatcgaaggcacgaagatcactgctctcaacagcgacggcgttgcaaaccagatcagtatcgacctcgaagatgcagaaggttcgctcagcaagccgcgcgtcgtcaagatcgagaacctcaaggtcgtggaaggtccgtacaaggtccgcgtgttcgaatccgcaatcgaactgaatcacatcacgcgcgacaacctccgctacctcatcgcaattgagtctgcgtaatgaaccgcgtagacacgcagaaggcaattggcgccgcgattgatctcgcgcgccacattgctgatctgaatgcacgcaactgggaagggtatcgtccgggttactcggactatgcgttcaagcagcagtttcaaacgatcaccttgaacttcgggcgtggtgttggacacagcacttacattcatcagaacgccgaatcagacgacctcgtcatctatcgtgatgcgtggcagatggatacggagattcgcaagttggtgaatgatcctctcgtcgcgaagatcgatcgcttgagaccgattcttacagggcgtaaagtgacgggcaatgtgtggatcgatacggcatcgatcatgtccaggggtgaaatggagaagatccacgaagcactggtagagcagccgaatatcaaacaaatcattatgttggggtgagtaaatggaaagtggtgaaaagtatctgtggtgtgaagagtaccgcccgcatcgcgtcgaggattgcattcttccggatcgtctgaagagctatttccaggcgatggttgaccgcaaacaaatcgacaatctgacactcgtgggtggtccgggtacaggtaagacaacggtcgcgcgcgcaatgtgcgaagagctgggcatcgatcatcacttgatcaatgcatctgaaaacggcaacatcgatacgattcgtaccacggtgcgccagttcgcatcgacagtcagtttcagcggcggaatcaagtgcatcatcctggacgaggctgactacctgacgccgacagcgcaagccgctctccgtggtgtgatcgaagagttcagcggcaactgccgtttcatcttcacaggtaacttcgcgaatcgcatcattgaagcgatcacgagtcgtgctccggttgttgagttcacgttcaccaaggaagagaagaaagatcttctcatgacgttcctcaagcgcgttcgcgatgtcttgaaggagaaggggatcgagtttacggcggaagagctgacgcaagtcgtcatcaagcatttccctgactaccgtcgcgtttggaacctcgttcagcgttattcgtcaacgggtaagtttgtcatcacgaatcagagcggcatcgttgagactgaactgaaggcgctcgttgctctgttgaaggagaagaagttcaatgacatgcgcaagtgggtcgttgacaacctcgacaacgatggtgcagcactccgtcgcgcgctctacgaaaaggtcgtctcgtcagtgaagcctcattcggttccgcaactcgttctcacgctcgccgaatacgactacaaagaggcgcacgtgatggacaaggaaatcaatatggttgcgatgctcaccatgattatgtccgaagtcgaatttctgtaaatatcatggaggttaatcatgtcgggtaaactatcaccctttgatcttgcctctcacctcaatgaaaagaaaggtgaattgaatgtcgaagaagtagggtatgaaccctatgtcatcaatcgagtgttttcgaacacgattgatactgtactcttcgccaacgagatgaatcgatattgggcgctgccgaagcaacatcagtttgatttctattaccatgggttgccgaagaagaagcgttacggcaaatggcacaagaatcaggacgacaaggcatccctagaactcattcaagagttcttcggttacagcttgcgcaaggcgaaagacgtactgacacttctacgaccccatttggatgagattgctcaagaattagaaaaaggtgggcgccgtggtaaagcaaaaactagttgaatcatttttcgaggtagaacctcttgatcgggaccaatttttgaaggtccgagaaacactgacacgcattggtcttccttcgaagagcgatgatggtgacaaggtgttgtggcagacatgtcacgtgttgcacaagcagggtcgttacttcatcgtccacttcaagcaattgttcctgttggacggacgatcacgcgtaacgaatttcagcgaggaagacgaggaccgtactgagttcatcgtcaatatgctggagaattggggtctcgtgactccgatggtacaagtggacccaaagatcgaatcgaacgtgctggttattccgtaccgtgagaaagacaagtggattctgaaacagaaatatacattagggaatgataatggcgaaggcaacaaagaaaacggcaacacctgcgaccgaaaccccggatactgataccatcggaacttcgttgagcgtagatgtgtcagacttgagcgcggaaagtcactacatgcgcgacgatggaaacgcattccggaatcctggaatcagctactacagtgaaggtggtgacgatttcatcccgcgccccgcaactgaaaggtctgcgggcgccgatgtcaaggcgtatcttccggaaggtgctcagatcggttactacgatcacacgaacaccaatcgtcgcaaggcagtgaaggacggaaagctccagctgtatccaggtgaacgcgcactcattccaacaggtctgaaggcggacattccggaccacttctggctcgcgatctatccgcgcagtggtacatcgtacaagaaaggtctcgcactcaataacagtgtcgcagtcatcgataacgattatgtcgaagagattttcatctcggtggtcaatcgtagcggtgtcctgatcgacattgagcacggcgagcgaatcgcccaagcaatcctccagccacaggtcacatgtcctgtgtacacgttgaaggagcagccgaagcaaaagaccagccgtgcaggaggttttggttcaacaggcagtaagtaaggagtagttatgagaggaattggtatcatgtggacgccgcaaggcatgatcatggcagatgtcatcggtgaaacatccgaagcatatgaacttgagaatccagtctacgttaacctcacacagcaaggcgcgcagttgtatccgttcctcgcagttgtgtcggaagagagtaaggcggaaatccgcaagcaggacgtgatgttcaacgggaagatcgcagagcctttcaaggaactgcgcaacgcgtataccgagatgtttggcggtatccagcttctcacgaagtaagaaagaagcggcgaggaacataaacctcgccgctttctctttgattatggatgaagcgttccttgagcgcacctttggttatgattagaatacgcattgcgtaattgacaggagatgcaattggctttttacacattttgtgaccgcgtaggcggcaaactgtaccatcgctatgtcgatgacaacggtaagcgccagcaagagatcgtcacagacgcaccatttgaattattcacacgaggcgaaggtggttacgtctcgttgtacagtgaaaagttgaagcgaatcgacttcgaatccgtcaaggagatggttgattacgtcaaaaactacaaagacctcatgcccatctacgggcgcaccgatccggtttcccagttcctctcgaacacctacaagggaaagatcgagtttgatttgagcaagttcaaagtcctcaacttcgacatcgaaacccgtttcgacggttgcgacgatgacgaagaggtacgcacgcgcatggtgtttggtctgacggaaacagtgatgaccgttgcagacctcaagcacattgtgaagcgacaggacggcgaagttgcaaccgtcgaagtttgggacgacgtgaatcagcgttggtaccctgccgacaaggcaccgcagttgaatccgggtggcttcccgcacgcgaaggaagcggactacgagatcctcacgatttcgtgtaaggtgttcggcaatgacaagcgcgtgaccttcggtttgcaccactacgaacagaagcacaaggatcagatctacatcaagtgcgatgacgaagcggatctcctcaagaagtttatcggcttcttccgtcaggtcgatccggacatcatcaccggttggaacatcgagtggttcgacgtgccctacatcatcaaccgcgtccgcaaggtcctcggtgaagcgatggcgaacaagttgagtccgttccacgcgcacacgagcaagtgcattagcgagtactacaatgacgacaagacagatgtgggcttccgcatcctcggcgtcacggctctcgactacatcgacatctacaagaagtacaatccgcagaagcaagagtcatacaagctggatgacatcgcggaagtcgagttgaaggagaacaaggttgatttcagcgaattcgacaacaacctcatgaaactctacgtcggaaacttcgaaaagtacatcgactacaacgagcaagacgtctacctggtcgaaagactggacgacaagaagcagttcatccgactcgcgatcaccacggttctcatgaccaaatcgcgatacaaggacgttcacggcaaggttaagctgtgggacaatctgatcttcaacatgctgcgcgacgagaacatccagctgccacccgatccgaagatcggcgcgaaggagaagatcatcggtgcatacgtcaagaagccgattgcgggtaagtaccgttacgtcgtctcgctcgacttgacatcgctgtatccgtccatctgcatgatgttcaacatgtcgccggaaacgttggtgacggaagagcgtggtgagctggagctggttgaagcgttgcttgcaggtaccgaccttgcacgtcgcagccgcgagaagggtctggcgatgaccgcgaacggtgcagagttccgactcgacatcgacggcgtgctcccgcgcgcgatgaagttcgtgttcgatacgcgtaagcactacaaggacctgatgaaggtcgagaagaagaaaaaggaagcgcttctcaaggaaggcgtcagcgaaaatgatccacgcatcactgagatcgaaaacctgattgcggcatacgacgcaacacagggcgcgatgaaggttctggcgaactcgggttatggtgtgaccgcaaacgtcgcattccgttacttctccaagagcatcgcgcagggcatcacgctcacaggtcagttggtgattcgttacatcggcgagcgcatcaattcgaagttgaacgagttgtttggcaccaacaaagattacatcatcacgtcggacaccgactcagtgtacatctacctcgacaacgtgccgaccgatccgaagaacgcggaacagtcaatcgaagagctggatcagttcatcgagaacacgttgcagccttacatcacttcgtcgttcgaagagctgggcgagaagatgggcgcaccgaagaacatgctcgacatgaagcgagaagctctttcggacgtgggcatctggcgagcaggcaagaactacgctctgcaagtctgggacatggaaggtgtgcgttacacgacaccggaactgaagatgatgggcattgaaacggcgcgttcggacaagcctaagatcgtccgcaagcagctggaaggtgacatcaagatcctcttgaacggcaccgaggctgaactacaaacgcgaatcaaggagttcaagaagacgttcttcaatgcaccagtcgagttgatcgcgaagccgatgggtgtcagtacagtgagtgcatggaccgacgcgcaaggtcggcacaagcaagggacgccgtggcagtcgcgtgcagcaatcgacttcaatcgtctgttgcgcgagaagaaacttgatcgtcagtacgagcgtattcgtaacggcaacaagatcaagctgttcactttgaagaagatcaatccactccaaggtaactacatcgcgttcttgacacaattaccagaagaccttggtatgcatcccttcctcgattataatgcgcaatgggagtcaacctatctcagtccgatcaaatcgttcactgacatcatcggttggcaagttgagaaggtcagcacactagaaagtttgttcggataataggagttagttatgtctacagttattggaaacgtgtatgggttcctcgtcggcgcccagatggaagccgcatcgattcaagcatcgacctcggcgaacctaggggttatgcaggaagaagagcatggttttgaacagcaagtaaagactcgccagacagcgatcctcatgcatgacctcgcgtcgcacggtatcgatttgatcatgcctatccttcaaattatcgaagcttggcgaaatggtatttcggatgacgtgatcatccacaaccttgaaacttacctgcagaaaatcgaggcataagtaaatgactgacgttcgcggcaatttgttgaatctcatcagtgagattcgaaatgaagtggataatttcaacgatgacgaggacatgtctgacttcgcggaacatccagaagtcatcgcgatcatcagtcaatcactcgcagtcattgagggcgtattccccgcccttgatgccgttgagtccgtaatgaatggatcgatcgctccaaacgtgttcctgcacagatggagagctgcgatttcgcatatgaaatatcccgacatcgaacctcagaatggtgaaggcgtcaaagaaactgacaaaatgttgaagcgcgtgtcgcgcaagagaggaagtaaatgagtttgatcgaacgtttgaaaaagtcgtcgaccatcaaggaagcggctgttcttgaaacatccaagttctttcagaagaaagagctgatcccgaccaagattccggttttgaatcttctacagtcaggtcagttggacggcggcttcgctgcaggtctgacgatttgggctggtccgtccaagcacttcaagacgtcgtttgttctgaccaacatgaaggcgttccaggacaagttccctgacggcgttgttttgttctacgattccgagttcggctcgccgcagagctacttcaagtcgttcggcatcgacacgaatcgcgtgctgcacatccctgttacgaatgcggaagagctgaagttcgacctcatgcagcagctggattcgctcgacgcgaaggacaatgtgtttatcgcagttgactccatcggtaacctcgcatcgaagaaggaagtcgaggacgcactcgatggtaagtcggtcgcggacatgacgcgcgcaaaggcgttcaagtcgcttttccgcatggtgacgccaatcttgacgttgaagaacatctcaatgcacgtcgtcgcgcacacgtacaagacgatggaaatgtactcgaaggacgttctgtctggtggtaccggtctcatgtactcggcagacaatgtgtacatcgtcggtcgtcagcaggagaaggaaggcacggaaatcgtcggttacaacttcgtgctcaacgtcgagaagtctcgcttcgttcgcgaaaagagcaagattccggtgtcggtgacattcgacaagggtatctcggcatggtctggcttgcttgacctcgcaatcgcaaccggtcacgtcgttaagccttcgaacggttggtattcgcgcgcgggtgaagagcagaagttccgcgagaaggacacgaacagcaagacgttctggggtccgatcttgacgggtacagatttcggcgaagccctcacgaaccgcttcaagctggcaacgggtgaaatgttccaagacagtgacatgtcggaagatgagtacactgaagttgaccttgcactcgaagaataagtagaggtatcatggaacttttcattgatgaagtgtccgacaaccacctcgttgtcgttgacattgcacatcctcagtacaagttcgtctatgagggactaaagtacgacgaggatactgatcaaattgtagtcgaagagttttcggtcctgcaaagcgagaaagtaaatattgaaacggaacttgaagatctagacgctcacggaggtttgattctccgtgagctgttcttcaatccagtttcaaactgaggtacaccagacccgcaagggctgttaatataaccacaacaatttacgaggctacacatgagcaagaccgatgcaaagctgggctttgaagtccacgaatatttgaagaagaagggcgttgagactccgacgattttggtcgaaggatctatgcagcaggacctgacttcttggaaggttgacgaaatcaccaagcactacgaaaagatcatggacgttttggggcttgatcgcgccgacgacagccttggtgacacgccgcgccgtatcgcaaagatgatggtgcaggaaatctatcagggcttgaacccagagaacttcccgaagtgcaccaccgtcgcgaacaagatgggttatgacgagatggtgatggagaagaacgtcaagatcatgtcggaatgtgagcaccacttccgcccgatccacggcgtcgcacacatcgcctacatcccgaatgagaaggttcttggactgtcgaagttgaaccgcatcgccgactacttctcgcgtcgtccgcagattcaggagcgcctgacagagcagatctatcacgccctcgtccacatcctcggaaccgagaacgtcgcagttgtcatcgatgcagagcacttctgtgtgaagcagcgcggcatccaggacatcaatagttcgacggtgacgagcaagctcggcggcgacttcaagagcaatccggacacgcgcgcagagttcatgcgctttgttacgggagcctaagatgagcctcgcacagaaagttgacattgcaacgtaccgactccgtgatatcttcaaccatatcacggggtctggtcccctcaacgtctatgtggcgacgagcggtggcaaggactctgtcgtcgttcacaagctcgcgcgcatggtgtacgggcgcaacgtgaagttggtgcacacaccgaaggtgacaggtttcaacaaggttcacccggacactgtaaatttcctctatgagcagtcggcagaatatggtctgtacagtgtgccgaacactgacatgcattcgttcttgctcgacaaccatttgacgatccaagttgacggcacccgcgcggacgaggcagatcgtactgatcgcagttcgaacgtcgtggttgatggcaaggatgtctctcgtaccgagatgaattggtacacacgcgaaggtctgtttggtcaggcttgcgttttccctatctatgactggagtgatgatgatgtttggaactttattgacgagtatcaggtcccgttctcgaaagaatatcctgctcgccccgcacgttgatgatgaactgatcggcgcctactcactcattcgcatgggtgagctgacgcacgttgcatacttcgaagagctggacgaagttcgcacggcagaagccgaagcgttctgtgctgcgtttaacttgattccacatttcgcgcagtatggtcttgagcatttgcacatcaccgccgacgacgttttgattgcgccgacagcacttgacagtcaccccgctcacaagcgtgtaaaccgcaccgcacgtgacgttcagcgccgcactggttgtcgcgttgtctattacggcgttgacatgagcacgcccgagaaggtcgcgttgagtgcggcggaacaagctgacaagcgcgcactgttcgagaagttctatccgtcacagaaggaacttctcacagacagtaagtacttcatcttcgaagagatttttgaggatgagttgacctacggtgccgtcgcgcagcatgatgatctcatcttcgcagtcgagattttcggacgcccgatgaagaattctgagttccaagaattgacgctcggctgcaagaccatcaatgacgtgttgaggaagtttccttctgaactgcattcgcgcctatccgtgataactatttcgtcgccagatggagaccagtactatggctaagattggacttgaagttgaaggctgtcaccacgtcggcgattcgacgctgtttgtcagcgcggaagagttcctcaccaagcgcgcaggcgtaagtaaggttctcaactcgggcatcgtgtcgcacatctacatcagtgaccatgcaggcgatcttgatcttgaagaggtcgcaggctacatgcgcgacaatcacgcggacacggatgcgacagtcgaagtgacatcgctgaaagactacccgcccgcacgcgtgcgcatcatgttcaacgcgaacggcaaaacgccggttgaaatcctcgcaactgcagagtacctgcgcgatacagtcgatcaggtcaagatcgaattcgaactgacatgcctcgtcgcaccagtcgaatcgtttgtttggacgtcgccggatcaatttgaaaacgacatcgagatttctctgtgagcaaactctacatccttccaatcgaacctctggaagagcgttacactggggagtggtatcgacttctccccggtcaattcgcccgacacttcgatgaggtgatcacgattgacggaacgccgacgacgacgcatgtcgaaaccggcacgttcctcgacatcaattcgaccatccactacaaggctggtcagatgcagaagatttcagagctgttccgattgaagcaaattcaaccgggtgacacgttcttcatcagtgacctagagttctggggcatcgaatcgttgcgcatgttgagtcagatcaatggcatccctgtcaagatctacggcttcctccacgccgcatcgtacacgcacgaggacgccttcgcagttgcagctccataccagaagttcacagaagtgggctgggttgcagcttgcgatggtgtttttgtcggaaccgagtatcataagcaagcaatcatgtcgcgacgtttgtggaagtttgcggaaacggaaggtgagtactggtctcttgcagatcgtatccacgtcaccggaaatcctctgttctcagaagcctactctacattctcgcaggcaaaattgcgccgcgcgcgccgcaatcgcatcttgctgacaaatcgtttcgacaaagagaagcgcccggagcttagcctcatgattgcgcaacgagtgaaggagcttcgccccgacactgagattgttgtcacgacaagtcgcccgaagtttacatccaatgatcccgatattttgcagtacgcacttgacctcgaggcggctggaatcatcacgatcaaagacggactgacgaaagatcagtatcacaccgaactgctcaatgcgaaggtgatgattacaaactctatcgaagagaactttggttattgcatcgtagaggctatactacatggatgtcaaccagttgcacctcatggcttgtcgcacgacgagttgatccgcaagtggaacctgttcgatgcggataacttcgatcaagcggtagaccgtatctgtgaaatcttcgacatgccgaacgatgtctacttcgaggcagaacaagagaaccgcgagaagatttggcattgtttcgacgcagttgactctatggcgaggcacatgatcgatgagaagaaggtataagtggcttagaggagtggtgggcgtcgatttcctaacggcggcgaccatcgctttcatcaatgaattttccaacctgccgccacacaaggttggattcatgcacatcatttgggatatggacaccaatgaatccaatatttgaaattgaagttcgcaaagctatcgattcgcaaactttcgcaccacattgcttagtgacgatgaagattccactagaacgcgttgtggatgagactaagcggatcgggcgcgatcacatggctggtttcattggtcatgctgtactcactgcaatggaagaagcgaaaccggaatgacagaacaagataactacaacggcaacaaactgcactatatcgtgtcgggcactgccttcatgtacatcaacacattgaagcgcggtcaggacgatgaggtgatcgattggacccgcaaacacttccgcgaaatgcagcgtggtccaaacgagtttggtatgctgttcaacgccttcactgagaagtcgttctgtcacctgttgcatgagaattatcgcgacgtgatctgcgacatgcacgcggactcgggcggactgcagatggtcaccatcggcaagaaggcaacctttgaggacaagaaaaaagtctacgagacgcaggcgaagttctcgtctatcgcgatgtcgttcgatgaaattccggtgcagttgctcgacctgccagtgaacacaccggtgtctggcggtgcgtacctcggtaagcgtttcgaccgttcgctcttgaaggagcgtgcgattgagtcgggcgtgaacctgcgcgagcagctggagtactttgactcaatcgacacggacgcaaagccgcttctgattgcgcaaggtaacgatcaagacacgttcaatgagtgggttgagatcgtgcagcagcagattcctcagcacctcttgaacaacctcggtggtgtggctatctcgacggcgacactcgggcgtggtgctctggagaacttcgaatcggcatatgctgcaatcgacatgcctttcaagttcgactgcaagcagatccacatgctcggactcggtgcattcaatcgcatggtcccgcttctcgctctgatcaagaacgggatgtacaaggacaaggtgatcagttacgacagcaccacgcacacgcgtaacctgatcaatggtcgctgctacgcgcggttgcacacgacgggtgagtacggttactaccgtttccatccgaaagtgtacgatgaactcgtctatgaaattctcatcgaaaagttcaagaagtatgacctcgggttcgatgatccgcgcacgttgcatcactacctcacgaacaactcgtactcggctctcgaaaagtgcggcgacgataagctcttcatgattccgaagacaaaggtcgcgcatttcagatactgttacgacagctacatcgatgaggttgaggagtacatggctcaccctaacttcgcatatgacgttgaagatcacctgacatcagcaaccgccgcgttcgctgagattcgcaatcgcacagactacgatcattggcgcaagcagtttaggcatagtattccttcaatccgtgtggacaagaagattaatacgttagaatcgttgttctaattgaggcgtacactatgaaagttatttgggtaaaatttcagcgcgcaggcatccacatgttccagcgcgcaatcagtgagccggaactaggggacgtttcgtaccttggttcccctcatcgtcacctgttcaagatgaaggtgtcgattgaagtgttccacgatgatcgcgagatcgagttccatcagtttctgaactacctcgagggttcgattgacaacggaactctgcagttggacaataagtcgtgtgagatgatcgccgacgatattgctgagcttgtgcgggttaagtatggtgcaaagcgtcgtctttgcattgtcgaagtatcagaagacggtgagtgtggtgcaacatgcacgtactacactcgtgacattgaaccggaaacagaatggaacggatcgtatgattgagaaactacagaaactactcgagcgcatcattgcgtggttcgagcgtaagaaggtcgaaaaccttgagaaggaaaacgcggacctcgaaaagctgatcgcagcacttccgcctactccagaagcactgccgttggatgaagatggcgacgaggacgcttttgagaagggattcaagtgatgtcaactaccgcgatggtcgttctggtcgttattctagctattgccgtcgtggtaatcgaaggcattcgccttttcacatcatcaaagacaagtgagaccaatgagcaagtttgaagtatccgaaatcttcatgtcactggaaggtgaggcacaattcaccttccatccgactgcctacattcgcttcgcgcgttgcaatttcagctgcccgctgttcaacaacccgaaccgtgaaatcacggacaagggctatgcacctctcgggtttgaaccgaaagactacgcgacgttgcaagagcttcctctgatcacgaagggttgcgattcgcagtactctgtgaacccagagttcgcgcacatgtggcacaagtgggagacggaagaggtcatcgaccagctctacagcgtcctgccgcaaggcaagctgatctacgacaccggtttgccggtcatcgtgtcactcacgggtggtgagccgacgttgaagtggaagcagttgccggaaatcatgttccacgagcgcatgaaagactgccgtcactacctcatcgagacgaactgcgccgtgccgttcaaggaagagttcatctggaagattcaggagtggctgcaaggtcatccgaagcgcatctggacatggagcaactcgccgaagatcagttcgagtggtgagaagcgcgaacaggcaatccgcccggaaatcgctctcatgcaatacgcattgaagaacatggtcgggtatgatcgcgtgaatcagtacttcaagttcgtagtgagcggcgacgaagccgactatgcggaagtgaaggaggtcatggagatctattaccaggcaggtctgccgcgcaacactccgatctggatcatgccgcaggcgtgtacgcaggaacagcaagcagaagtgagccgttcggtcgcgactcgatgcatgagggaaggctggttgtattcgcatcgcgtacagaacgatctatggggtaacggagtcggaacatgagtaaagaacgctcacccgcacatttgtatatggatcagcaagtcgaaaagagtcttgctccattgcgcgccgcacttgcagacaggaaacctaaaaagccaactgaacagaagcctattccgatcagtgccgccaaggacatcgctcataaatatgactacgaccagatcatcgtgattggtcgcaatacgacgacaggctttgagcatgtcacgacgtacgggaagacgaaagaccactgtggcgcagcagccaagatcggtaacttcctcaaattcaaaatcatgaaatggcctcaccaagaggattgaacaatgaaatttctccaacgtagtcacgacggcggtaaggattccggcgtcgaaggtctctttttagttgagatcaagtcactcttctcaatcgtacttcttcgattcaacgaaggcagccgtgaggcgtatcacagtcacgcattcaacgcagtgacgtggtggttgaagggtgaggtagaggaacatcacacggacgggcgcacgatgaagtggaagccttcattcaagccgaagttcaccgcaaagaattgcttccataagatctacgcactacgcaagtcgtatgctatttctttcagaggaccctgggacgacacgtggcaggagcagcgtaaaaacgaaacagtaacgctgactcatgggcgcaccattgtagatgcgcaataatagagattgaacgccgggagtcacaatgacagatgtaacaaacgaacgactagttttagcttcgctcgtcaagaacgaagagtatatgaggaagtttttgcctcacatcaagcccgagtatttcgaggacctttccgaacagcgtcttttcaaactcatcgctgagtacgccggaaagtacaatgagccgccggatcattcgacgttgcaggtcgccgcgcgcaatgatcagagcctcaacgagaagcaaggtgatgaccttctgacggtcatcaaagacgtgggaagcattgttccgacaaagaacatggacttcctgaaaaagacaacgcaagactgggtgcagatgcgcgccgtgttcaatgcgttgcagaagggtatcgccatctatcaaggtgaagatacgacactcacaatcgcagcagttccggacattctggcacacgcaatctctgtttcgttcgaagcacagattggtatggactattacgatgacgccgcacagcgttacgagttctacaccaacccagagagtcgcatccacttccgcatggagcctttcaacgaggcaacgtgtggtggcgtaacacgcaagacgctgaacctattcgttgcaggtacgaacgtcggtaagagtttgggcttgtgttcgctcgcagcggactacatccgtgacggatacaacgtgctctatatctcgttcgaaatgcgagaagagctggtgatgcagcgtgtggacgcgaacatcctcaacattccggcgaactctctcaaggacatcccgaaagagaagttcatggatcgtgtcgaagcgatccgcgcgaagtcctacggaacgttgaaggtcaaggagtttccgccgtcgtcggcatcggttctcaacctccgtcaagtgattgacgagttgaagatgaagaaggggttcattccggatgtcatcatggttgactacctgcagatcatggcgtcataccgtcttccttactcggtaggtagctactactacttcaagtcggttgcggaagagctgcgcgcactcgcagttgaaacgaatacgacgatctggtcggcggcgcagttcaatcgatctcagatgagttcgacagatgtgggcatggaaggtattgcggaatcagcaggtatcgcacacacggcagatggtatgtgggcgctgattagaacggacgagttggaccaacagggacagttgatggtgcaacagttgaaatctcgatatgctaacaaggcggtcaaacctcgattcgtcattggtgtggatatcgataggcagatgctgttcggcgtcgatgacgaccgatcagacaagcttacccaaccaggtgggggcggtcatcaaatcttgagtcaaactgacctcaaggcgaaattcctgggacttaacacagattgacaactaaggagttacaaatgaagaaggtatttgctattgcaatcgcagcggctctcttgacatcggcaggttcggttgccgcgcaggaagtcaattggaactacatcggcggcggctactctgcaaccgaaatcaatccgcgtgactttgacgcccgttcattcgattcttggtacggtgaaggctcggctgctctcggcagcaacggtttcatccagggtcgttacacgaagggcatggacgcggacttcccatcgggtatcgcagcggtcagcctcggtcttcgtaccggtcttgacgagcgcacggacctctatggtaaggtgacagccgcaactgtcgtctcgcagcgtcaagacttcgacaagtacaactattcggctgaagtcggcgttcgcgcacaggcttgggaccgcgttgaacttcgtggtggtgtcggcgcaacggaactccgtgatgcacgcttcgactcggttcgctggtacggaactgttggtgcagagtatgctctgactccaagcctgcgcctcggtgcagacgttcgcggtaagagccgcgagttggaaggtcaggtcggacttcgcgcttacttctaatccaaggagactcgttatgacaacaccaagtgaagatcggattgaagagctgcttgaacttgcagaaggtcaactcaacgaccaagagtggtttgactatcactcatgggatggattgatcgaatgcgacgaagagctggactacgaagagctgcaatggatgtccgagaacttcgaagtgaccgtgacagtaacgcgcaaagattgacgttagtacgtcaagaagccccggtttcccggggctttctacttgtggatcaggcagttactagcctcgtactttgaggttgaacttagtacgaacttgtgtagaatgtctttcatcggaacacaaacacacaacggaacgcagacatgaacatcgaactgaacgcaatcaagaacgaactccgcaaggcctttggtgacacgattgcgaccggcgacctggttgcgtacagcccgaagtacatgcgcatcatgcgtcagcacggtcgcctcgttgcacgcggcgtgtgggacctgacggatgattgcagcgccgtcatgccgggtgattcggtcaccacgccggtctcgatggctcccgcgatgacgcgcgaggaactgtccgcacacatccgtaagcgtttcaacgtcctgacgacccttgcgaacggcatcactgccggtaacgtccgcgccctgatcatcgccggtgcggcaggcgtcggcaagaccttcgaactcgagaagaagctgaccgccgcgcgccgcgacggtgacattgacacctacgaaacggtcaagggttcgatcagcgccgtggtgctgtatgaaatgctctacaacaatcgcgaagaaggtcaggtcctgctccttgacgacaccgattctgtcttcgccgacgacgaatgcctgaacctcctcaaggctgcgctcgacacgtcgaaggtccgcaagatcagctgggcgaaggcttcgcgttacctcgccgattcggacatcccgcagtcgttcgagtacgaaggtcagatcgttttcatcacgaacacgaaccctgacaccgtgatcgcgaagggcggacgtctcgcaccgcacatgtcggctctcctgtcgcgctccgtgttcctcgacctcggcatccacgattgcgcgtcgatcatgattcgcgtcgagcaggtcctctcggaatcgacccttgccgcagacctcggtctgacgaaggcacagaccaagatgatcgtggagtggatgaacgagaatattgacaagctgcgcagcgtcagcatccgcaccgtgatccagctcgccggtttcatcaagacctcggacgagtggcaggatcttgccgaagtgacgctcttcaaggctggtcgcatctgatgaaacgacacgtcgcgaagcctccgcatcccgatgtcagactccgcgaattagcacacaaagtcgcagcgaagaagccgggtacgtatcacccggcagttctcaaagccctgaaatacctgatagagaaacggatatgaacatcgaacgattcaagaatcacgtcgcaacaagcctcaagaacatcgaacacgcgcagcagaatccgattagctgcgacatcgatcaggtgattgatgacgagaagaacttcctcgccgcaatctacttcaaacaacatccggaattttcgcagctcgatcagatgatctgtgaatcgtacttccggtacttcctccaacgcatcctcaagattcaactcgaaggctgaaatcaccatgacaatcgtaaaagcacacgcgatgccccgcgttatcgacctcagcggacctgacggtaacgcattcgccctcctcggtcaggcacgcgcatggggcaagcagctcggctggtcccctgaaaagatcaaagcgctgcaggaagagatgaccgcaggagactatgacaatctgatcaaggtgatggatcgcgagttcggatcgttctgcaccttcatcatgccggatgaccgcaacgatgacgaggagggcgaagatgaagatgaaggttgaggtcggcgataccattcgcattgatgagttcgaacatggcgcccctaagggagaggtagtgaaggtggtcgccgtcagtgacagcggcatggactacaggtacaagtacaaagggcacgtgttccataccggacccggcgcatgttccgtgcagactttcattccggttcccgatcccgagaactgaaaccgtgtcaacctgaatcagccccgcattgcggggctttttcgtgcgcgtcatcatacgtcagggctgtcagtttgcaagcaagaatcagtaaggtgttgattctacagtgaaaatcgtagcgaagggtccatcgctaaccccttgattctacttgaattgccgatctcgtcagggttcgcggatcgataaatacccggatcgatcaaacacacaaggacaacagccatggcactacgctacttgccggaagcgatcccaactacaatgggctgggcgcatccgcttacaggtgaacgcatcgacgtttcacacggtctcgcagacccaatcgactactacaagccgaacgcaggcgcgcgctcattcatcgaccctgacggcgacacgactccgctcgcgttctcggttgtcacaggtcgccgtgcgcgcatgattgtgcatacgctcgacaagcctaagcaggtcaagtgggatttcggtgacggtactccggtcatcacaagcagcattcgcgcgcagcacatctacgcgactcaggctgagaacgaaacgtacacagtcactgcgacactcatcgatgccgacgacgaagagacgccggtggaattcgaggtcacaattccaggaacaaatccgacaccagctccagagccggacccggaaggcgacgaaactccgtaatcggaacattcgaaacagtacccttaaagccttggcggtcaaacgtcagggctttaaactgtgcggaaataccttgaggattcgtcatgggcggtaatgtagtattcggtgacgcagaagcgacacccattgatctcaacaaaactgatcgacaagttgtccttgaagagattcaagagttcatggacacactgcgcatcacgaattctccatgggcatttgggaatgcggactgctatttgtcagggtcatcggcgtggctcgccgacaaaacgatttcagccgaggaccttcgactgctgaagggtactttttcggacgtagatatcatgttcgacaaagcggaagcggacaatctagtcgcgttcctcgcgtgtccgcgcgcgagtaagcacgcgcgcaacgcggagctggtcggcttcaaacgcagtgcaaacaccatcgtgacattgtgggacttcgattgtctcgacggctacacgcaggtggattttgagcttgtagacttcacgtattaccacaatatcgaagatgacgaaggcggcgctccgactaactgggcgcgctgggcttacagctcatcatgggatgattggcgcctcgcacgatgcaaaggcgttgcacagaaactgctcttccgcgcgtgcggcgcgtacactggcaagttcatgacggacgcaagtgggtaccagttctgggacacgcaagttgctctcagcaacagcggtatgcgtgagaagtatgagtacgggcgcaactgggtggtgatcggaaagaacaaaaaccgtgagttcatcaccgaccgcaagaagatcttccgtcgcatcttccctaacactcaagtgacgaccgcgcgtgtcgatctgttcttctcgtccttcatcggcatgatcgactctatcaaactgtttggtaaagacacaaccagtgtggtcactcgattcgctcaaatcctcttcgacaacaatgcgcaagagctgtatcgcgataacccggcgaaggactatcatacgaaactcactatgttccgcgaactgacgacacgcctaaatatgaatatcggcgcgtggtcggacatcatcaaagcatatggcaactttcaaaacgacggacttcttgaagaggcagtacacagagactctctgtgagttggctcgaactcgatctgaaatgatctcaggcaagcagcaggacggagagacgatcaaactccgtcctgttgtcctacttgctgacgttgagcagacgatcaccaagaagaatcagtcacagattgtcgatgcgattattgccttcatcaccaagaatcgcggacagccgccatacctggttgattcgaagggtcgcactcactcggtgatttctctctaccgtgatgcgcgattcattccaaagacgcgtatcgacgcggacccgaacatgacgggcaaggcgcgacagcagcgtcaggaactcggcgtggtatcgtcggtgaacgaacttgctctgtcgggtgacgtgaagttgaacggtgtcaatggtacagtcgtcgaggcgatgcaggcacccgacatcggtcctcacggaaaagagaacttggttgacgtggtgctcaagttgaagaacgggcgaggcttgaacgtgtcatgcaagcagacgaaggcggctgacttgggtggtggcggtatggcgggtctgtcgaagatcgccccactgctcatccgaaagctctacgcgaaggtgcaagccgacctcaagaaagatggttacgtcgaaggtggaacgtatgcgacggctgacatgccgacttacgtctacaagattccgaatgcggagttagagaaaatctttcatggtcatgatgacatcggcggcactatcgattacttttacattggtccggacaaagtgtctatcgaaccgaaccgccagttgaatggcaagttcatcagtgttcgcgactttgctcaggcgaaggacttctatttccgcttgcgtacgcgtgacatcgtgaacggcaaagtgacaatcgactacaagaagaaaacgaaggaaggcttcccggcgatcttcactacgggacctgcaaaatcgaacgcggcgcgattcgtcattgacgacgcacctcctatctcagcgaagaaacgtacattatgacatcgaatggcttgcctcgaatcggctgacatcctcaaacgcgacaacctcaacgtcttgctggacattgtgcaggcgggcggttctttgactgtcggatcgaaaggtgaaggcgagaccatctgtctcatgagtaagatccgcttgtgcggaatcatctatcacgtcacaccgtacacgcgcgcgggcgtatatgcgcgtttgcgcgcgcattgcgaaactgtcaaaggctcgccgcctgaggtctgcgcggcgggcatctggaaacgcatcactcacttctgcaaagacgcgcgtttcgtgccgaagaattcgatcaaaggcgcacccgcgatcaaggacaagctgtttcagcagcgtcaggagatcgatctcgtcgcggcgatcaatgtaaagccgatcatgattccgaactttcagtacaagatcgtccgtgcagagcaggcacccgacatcggaccacacggcaaggagaacctggtcgacgtgatggtgtacgatgagaaacagcaggtgttcaacatctcatgcaaacaggattccgcagccgatctaggtggtggcggaatgacaggcttgattaaaactgtaccaggcttgatcacgaatctatacagcactgtgattaaggacctgacttcctttggattcaaagagacagtatcgtacaatatcaatgagattcctcagtttcagtacaagattccggacacatttacctacaagattttcagaggatcggaacagatcggtggcgtgatcgactacatgtatgtcggtccttcaactgttgtgctgacagaggatcgaatgaatgggcttttcatcccggttgagcagttcgcacgcaagagcaactactatttccggttgagaaagcgcgacgtatacaacaacacagtgacgattaactaccgcaaattcaacatcaatggttatccggtgattttcacatcgggtccgatgcattcgcccgctgcgagatttgtggttgaagatcgcgttctgaaaacgtcaatagtgagagagatcaatgagtgaactagtgacacctgtcaaacgtgtagacatgaagcacctgcacgagatgaacaacatcaagttctgtgagatgatcatggggtcgggcgactatctcgacgcacatatcacgatgaagctggacggattcctgttgcggttcggcaaagatgccgaaggtaaattcttcatgcaaacggcgcgcagccctgtcctccgtcgatcagatgagatcctctggttcgctctcatgcgcgattatcgcggcgaggcgttggagcgatcacacaagttcgcgcacctattcgaagtgctgaaacagagcgacttcttcgcgaaactcgaaccggacacggcagttacgtgtgagtgcttcctgcgtgacctcgcggagtacaacgaggcttcgaacacacttcgctatgtgacaatcccctacaatgctgacatcatgaagtcgccgtgcatcatgtacgtctacgacgtgtacagcgcgaagactccggacatcaagaagtacgctgaggttggtgcggatacgcacatcgaattccgcacgccgttcctgcagtggaccgatccgatggggcttttcatcggcgactaccacgaggcgattagcggtctgtcgaaggacgacatgttcagtctcaccacgcgcacgcacgcatggcgcgagcgcaaacgaaaggtcaccgagttcctccaagacatcaagggtgacatggcgaagcgtatcctggatgagaagacgacaacggaagagacacgtggaatgggcagatattttgaaggaatcgtgctgcacataaataatgatcagtacaaggtaattacacctgactacacgatcatgcggacacaaggaacatactcgtgaccgcatgtgatctgtactttggtcgctttcagccgtaccataatgggcatcgcgaagctttgaaactcgcagaaaacccagtagttcttgcggttgttcgcggaaaagatacgaagaagtcaccgattcctctcgagtatacgatggaactggtgacgaaagcggaacctgatgcgcgcgtgatcacagtgggtaacggttacatccccgacatcgtgcaacagctccaagatgagcatggtctagaagtcatgaacatcatttgtggaccggatcgagttgatgagtacaaagcacaacttgatcgttcgaagctggaagacaccgtaaataggtgtataaagcttctcccggcgaagagggtaacctcagccacggaagttcgtgagacccttcggtctggcgatcagatggcttttcaagccaaagtcccaaaagaactgtgggatgaattcactaacttaacgaggtacatcggaaatgacaacacttgacatcggaacgatcccaacattcgaacagttcctcactgaggattcgaagaagatttcagacgcgaaccatcacaagaagactggcgacacttcagccgacacgctcgcagagcctaaggaattgaagccggaccagggtcctaagggcaccgacacgaaggaaaacttcgagaaggcgaacaaggcttccctcgacatgggcacacgctcagctgctaagccagacaagactgtcacagtcaagttgactgaaggcaaggaagagggcgaaggtgacgacgaggaagaaggcgacaagaaggacggtaaggacggcgacggcgaggatgagtaatccgtctaacgacgccctccacgaagatgtagcggctgcgggttctgccccagccgcttcacctgttacttcgaacgtaacagccggggtgaagaaccctgagaagccgatgggacacattgcacgccgcaagaagaaaggcgaagagtacgaacacgctggtgacatcgacaaggccatcaaagacgctgcaaagcgcaaattgaatgaggtctcacgatggaacgcgcagtctcgctcttggcttggcggtggctgggacgagcgtcaccctgacggcgacccgcacaatccggcatcggcggcaacacaagcaaagcgttacgcggacgcgacaaagccatgggagaagccgaaagactggaagcccatgatgacgcatcgcaactacttcgacgtgccctacgagatcaaagactacgcaaagtcacgcggtctgcgttgggatccaacagtcaggaagtggtacaaagacgcgaagcaatctggcggtacgcaactcgacatcatgggtctgcaacttgtcgatgaaaagggacaagtgatgggcacaccgaagcgaaaggtgtatgtgcaagttgaaaagggcgaggaagcacgcgcaaaactgcaaggcttccgaaaggacaacaaaggttggtggacactcatgcgttcaatctggaacgatgagacactctcaggatacaaggtactgcgataatggatttccaggattacctgctagaacaattgatggtcccgaatgccgaatcaagtgacattcaaaagcgccgacacactatgccacaactaacgaacttcgacgcgttcaagcaagacttggatgcgtcacgcatcaatatctctggaccacgaaaggtccagcctctcatactgattccgtcacagacgaatttcagcgaagagaaggtcaacacaattgccgcgaacaagtcgaataacgacaagccgatcatcattagtgacgacggctacgtgatcgacgggcatcaccgttggctcgcgtcgtgtaaattgaaatgtatgcagctagctagaacggttgctatgagcgccgaggaaacgtttagcttcctcaaaggcaaagactatgttgaaaccaagcgagttaatcaatgagtaaactgagaacaccacaatcactgcgttacaaggtgtatgtggaagagcttaaaagagacatcaatttccgtggtatgcgagttggagagcagaagtctctcctgacagcaattgagatgaaagagcctcatgctctgatcagtaatatcatcgatgttgtatctgattgcgtcttcgatgaggacgtaacgaaactcccaatgcacatcgtggatttcttgttcctccacatctacatgaaggcggctggttcgatggctcgcgcgcaatacatctgcgccggtaagatcgagaagccgatcatcgaaggtgaaggcgaggatgcagtagacaccggtgaagtcgagattgtcgattgcggttccgaacacgtcttgaacctcgacctatcgcgcgcccagatcaagtacccggagaactacgtcggttcgaaggtgatcgacttgggcgatggtatgcacgtcaaaatgcgcatgcctacgttcgaagtgttccgtacactcgacttgcagaagggtgtcatggacgttgcggatcagttcatcttttcaagtattgagtgcatcgttgacggtgaagacgtcaaaacaccaggcgtggatttcacgattgatgacatggtagagtgggtaaatacgcttgatgcggcacccatgaaagagatctctgaatatcttgacgaaactccatcactataccttcgcgttggtgtgacctgtccgaaatgtggcagggaggaggttcacgagttacagagcctcgaggattttttcgggtaatcttctcgaaagagaagttgcttgaagtgtacaaactgatccacatcttggtacaagaaggcgggtacagtttgacagaactccacaatttgccattgtacgagatcgagttgatttcgttgaccgccacagaattcaatcgcgaagtttctaacaggtaaggtataatggcaattccggcaattctaggcgcagcagcacgtggtgctggagcacttgcatctcgcggtgcaggtgcagcctactcgggtctaaagacagcagcagtccgcgctccaggcgcggctttgcgcttgggcggcgttgacaagattccactcggaaagatcgcgatggatcgctctgggcagatgttcgacaagttgatgtcaacgcgcaagcagcaggaacaacgcaaagagaacactcgcagacagcgacaggagcgtcaggagagcacaaagactcgccaggacgatcagcgtcaggaacagaaagagcagcagaaagagaagcgtcaactgtcggaagcgcagttggctcaacgtcgtgcggctgcacaacagcctcgccgccgtaatgcgttgaaggctgaaggtgacgagcgcgacaaccagaatcgtcagcagtctgcacatgagaacacgaagtcactcatccctgacgaatcacaaggctacctaaagatcatcgcgcgcgacattccggtgatcaaggaaggtatcgaccaactcaacaagaagcaaagcgaaggcggcgagaagggtagtggactactcggatcacttgcgtctggcttgatggcggctgtcacactcggaatcggtgccttgcagaagggattgatgggtctggtaggtcgcacactctcgactctgatcccgggcgtcgcacgcgcgttgggcggaatcgcagggcgtttgctcagtggtgcaggcggcgtcgccgcgcgtgcattgggtggtgctggaggactagctgcaagagccggactcatgggtgccggattactcgcgggcggtaaggctgcgggtgctgtcgccgcgcgaggtgctggagcagtcgcgaaggcgggtagtggcatggttggcaagaccgtggcaaagggtgtgggtaaagccgtcctcaagaagattccgattatcggtgcaggtgccggtttgatcttcggtgcgcagcgtgcaatggctggtgactggacaggcgccggtctcgaggttgcatcgggcgctgcaagtacaattccaggtcttggaactgcggcaagcgtcggcatcgatgcaggcttgatggcacgcgacattcacaactcgaacagcgcagctcccgcaactgtacagcctgcaccggtagttactgcaccgaaggcaacgaagtcacgcatcttatcggcaacaccagcacgcgttggttcgcctgcaactgaaaagcctacacgccttgaggaaatgcttgatcgccgcctcagttcgatcatggcttctcttgcatcgatctcgttcaacatgattacgccaacgcgcgggatctatgtcagaccatcggaagcaacaaagacgacgttcgatccgtctgcgcctggcagcactgcagcaaccctcggacctgcaacgaataactcatcatcgggtgccggtggttcaagcgcagtcaacccgctctctggtaactcatcactgggtgcaactggtgacgcatcggctcttctcgacttgatcgcgaagggtgaatcgggcgcggctggttacgacgcagcgtggaatggctcgcgcgtagctccgagcaagcctctgtctcaaatgacgattggtgaagtgaaggcgtggcagcgcgagacattgaacgagcagaagggtcgcggtgtccctgcaaaccgtcgatcatcggctgcgggtcgctatcagttcatcagtggtacgcttgcggcaacagcacaacgcgcaggtctttcggatgacgacatgttcagccctgaaaaccaggacaagctcgcgttgaacttgctcaacgcagatagtcgtcgtggtcttgaagcatggcgctcaggtaaggcaagtgacgcacagttccaagactacgttgcttcacagtgggcatcggtaaagaactcgagcggaacaggtacctacaacgcggcaggcttcaatcatgcgagcatcagcggcaacagcgtgatctcagctgcgcgcggacaaacacaaggcgctccactgacatcgaactctggtccgcgcatgtcggcggaagtcgcacaaggcgtgatgatgcgtcagcaagcaagacaggcggcaccagtggcaccgcccgtcgtagttccgcaactttcaatccctggtatgcagacgaagaacaatcagcacaacacgcgtccacctatgatggtgcgttcgcctgattcaccgattcgccgacacgcccaggtgcttattgggacgacttaaggtcctcgaccttttcgttgtactgctcaacctgttggcgaacagagccttcccaagcttggcaggctcttagtcgttcgacgactcggtctgcgtctccggcaaaactgtaaagaaactcagaagtctcttgagaaagtacccctcctccggtaccggctccgttaccgctgccggtgctgccggaattaccaggggttcctggtagaccaggtcttgatggctcttgcagcctgataccgcgaagagcagcaacgttactagtgatagtgtccagattcgctttgtacttgtcattgatctcatcctttgatgcgttcaaattgttggagaaatccaactggtattgagtgagtttcgtttgtgcgcgtgatacggcgaggtcacgttgagtgagctccaaacggtggtccgcttcgagtttatcgtagcggttgtccattacgtaccacacaccaacactggcgagaaccgctgcaatgagcgcgatgatcgcagttagctgtagtgatgtcataaatgctccaggttaaatcttactgaggtgtccttgaggatgtcgaccatgatacgattcgggtacacatttggagcaatcttgtagtcgtattgcttcaaaaagatgagaatcgccttgacgacgctaaactgtacgtcatcaagcagatgacgaaagatcattgtgaccttagttgacccaaacacgttgagtgcggtaacaatgttgttcatgagaagcttctcattgacgacgcccgttttcaagaagcgggtcgtcatcttccgagtcgtcatgaatacattgaactcttgctcaaatgtagcttggtggtacgcggaagtaccgtagccgtgcatagcaattttccgcgcaatgtctttcttattatctgtactcatgatctagatcttattccttagaagcagatgccttcttcgacgtgcgctttgttgtcttcttcgcgacaggctttgtttcttcggctgccttctcttcaatcgcaggcgcgacgatcttctcttcctcaaccttgtccgcagacttcacggcggctggtgctggagtttcgatgcgtgctgcctcagtatcaccggctgcattcgctgtaccacgtggagctgtcgggcgtgcgcgaccgccaaagtctgccgccactccgccgcgcgtaaacgtgttcgccttgcggtcccagttatacgcgttggtcaatccgcgaacggataccaaaagttcgccagttttgtgattcacccagccgagctgtgtcgctactgcgtccggatttcctgcaagtgttcgtgcttttgatttgtcagttgccatattatttcacccttggattggttctgttagttaacctgtcataaaatgtgaccatggattacattgatctaaaatactcaaggcttgtgtcatcatatttaaccggttggaaggaggtcagtcgaactgtccaaactttccgatgcccgtattgtggcgattcaaacaagtcgaaatcaaagacgcgtggttatttctacgagtttgaggatgagtgcatgtacaagtgccacaactgtggtgcttcacagaaactcatcacattcctcaaggagatttcaccggcgctcgcgaccgactacatcttcgaacgattcaagacgaagggttccggcaatggtgctgcactcgccgatgacatgttcaaaaccgacatgcgcgacctcaaaccgacgaaggttgatctgttggatgaaacatgcgtgcgcgcgaacacgttgaacgacgatcatcatgcgttgaagtatctccgtggtcgtctgatcccggaagaccagattgcacgtctctattactgcagtgacgtgacgaagatcgctgacaagctgcccgagtacaaagagcgcgacacgcaactgccgaagaaagacgcaatcatcattccattcatcgatgacaagtcaaatctcatgtatctacagtgccgattcttctcggaggatttcaggtacatgacgatgcaggtcgatgagaacgggatgaagctgtggggattggatcggattgactggaacaaaacggtctatgtctgcgaaggaccgtttgacgcgatgtttcttgacaactgttgcgcggttgcaggtgcctcgattatgtcgattgttaaatacattcgagaccgggctaaaaaagacgttgttctcatatttgacaaggattaccgcacaaactacgaagtgcacagccaaatgctgaaggctgttgaagcgggaaacaaaatcgtcatctacgacaatcagttcgaggctaaagacctaaatgcttacatcgaagatggacacactaaatctcaactacgtgagtatgttgagcaaagaacattctcagggctgatggctaagctagaactgaccaaaatccgtcaacctaagaagagaaaatatggcgaagcaaaaaccaaacaaaagtcgagagccttcaagccaaacttttgagcacttcaacttcgagccaatgacacaaacccaagccgaagcgcagatgagcttcgaagagggtaaaaatctagtcctttcgggatacgcaggaacaggcaagacacacgttgccgcagcgttagccctacaaggattgatggacaagaaatacaagaaaattcagctcttccgttcagcggtttccacccgcgacatcggacatcttcctggtacggaagaacagaaactcgaggtctacgagaagggatttagaaacacgttcaacaaactgttgggtcgcggcgacggttatgcgatgcttaaagccaatgggacagtgaatttcaattcaacgtcgtttgaacgaggcgtcacgtactacaacacagtagtgatcgttgacgaattccagaacttgacgtggcacgaaatcgatacactcgtgacccgactgcacagcacttcacgtatcattctctgtggtgatacgcgtcaaagcgacatttcagtgcacaagtccggattcggaaccctcacgaaagtcattgacaagcttccagactacttcgcgcatcacgagtacgcaattgacgacatcgtgcgcggcgaaatgatcaagcaatggatcatcgccacagaagaaattttcacagaagggaacatctaaatcatgcaagaacaagataatgcaccggttgaactcacatcgacgccagccgaatctgaaatcgtccagtcatactcgcgggatcagctcctgcagatgatgggtcaactgcgcctgttccatccggacgggcgccgtcgttcgaagcacgcgggcgcacgtgttgcacgcgcgaaagcaaagcgtaagaagaagtaacagaagggcactaaaatgagcgagaatggaaagcgttttgtcaatcacgtagaacacattccacctgcacacgaaaagcgcgccgaaagacgcgctatgcagaaactcaaacaagcggacatccgcgacgaagattgggatgactacgacttgaaggcaacatcccagcctttcaaaaagtgtcaaaaactagccgataagtgacattggagtttcaccttgattatctatgatatgagcaacatcgtcttttcgcaggtgctcgatttccatgcgaagacgaaagagcaagcggacatgcagctgattcgaaatctggtcatcgacaagatgatctcgatcaagggtaagctcggaaagtacagcgatgaaatcgtctgcgcgttcgattcgcgtcactactggcgtaaggatcatttccctcagtacaagggcaagcgcaagtcggatcgcgaaaagtccacgttcgattggaacgcattcttccctatgtacgatcagttcaaggaagagattcgcgagcacttccctgtcaagtacatcgaggtttacggttccgaagccgacgacatcatggcgacactggctcaggtctatggaccaaccggtaacgtctgcatcgtctcgtctgacaaggacctgatccagttgcagcacatctgtcctcaggtcaagcagttctcgccgtaccatggcaagttcctgacaccgaagaacgctgattacagtctcatggagcacatcatctgcggtgacgtgggtgacggcattccgaacatcctgagcgacagtgacaccttcatggttcagggcaagcgtcagaaggcgatgcgcaaggacaagctgcaagagtggttgaagtgcggcataaataatccagaactgttctgtccaacggcggaagctctggacaagttcatgcgcaacaagcgcctcattgaccttcgcgagattcctgtcgaattgactcaggaaattatcaaggcttacgatgaatatgtgatccctcgtggaaaaatgttcacttacctgaccgcgaatcgtctatcacgaatcctgaaagctggtgggttttaatgccgaagtatgattttcaatgtaactcctgtacaaacgtgcaggaggttgtgtgtaaaattgcagagctggacacgatccagccagaatgttctgagtgtggaaagaccgggatgacgcaaaccttcatcacggcaaatcatgcgttcatgccgcccgaagcattgggtcgcaaaaaggcgccttctgatttccggaacatgctcacaatgatccataaggcgaatccaggaagtcagattcgcgacagataataagagagatcatgatggaagcaagtccgtatattgaattagttgacaattttcgagccaatccgctcaacgcgccatccgcaaagtttccaggtgtcacacgtgtcctaggcggcactaaagacatgacgggacttaacgcgtggcgcgcgcgtgtaggtgaggaagaagcagatcgcatcgtcaacgagtcccgcgcgattggtagttcgctcgaccgtatcttcaacgatgcgtgcgatccgcataatcaatccaatttcgacaaatccttgtatgagcatgaggtaggctataaactgttcaatcagttggagccgatcatcggaaagatcaaacccatcgcagttcagatgaaggtttggtccgaaaacatgcagatgatggggtacctggatttgctgggtatctacaaagatcgtctcacactgttcgattgcaagaattcgaagcgcgaaaagacgcaagagtacctgatggactactaccttcagtgtacggcgtactcaatgatgctctatgagatgaccggtctgcagatcaagcaaattggcgtcctcgttgcacgtcgcgactcaccgtttccgcagatcgaaattcagcctatcgcgccttacatccctgaggtgttgaagcgcgtcaagcagtactatgcattggagtcggtatgaagttggtattggaacaaaagagtcagatcgaagttgaggtcaagccctatgcggtgctggaccagatgttcgacttgtggcgagaaagcattgcgaaggacttttacttcgcacgcgatgggatcgcgtataacatgggcggagaccctatcaagaagttgaccgatgtcgagtttgcgatcttccgcaattggctcgacctactgcgcaacatggaggcatcacttgagatcgagtgagaagattctcgaagagctgattcacctggctgagagaagtaagattggtttatttgaggctgcctcggattattgcgacctgcatgatctggagcaatcggagttcatttcaagccttgatccgtttgtgatcgaacgattgaaggcagacgctgtgagtacgaggaaagtaagacgatgcgttcaacgaccaagctcgacactaatctagacgatgcgctaactgcattccaagattacgttggcttgaagctgcacttcaacgaggaccttgtctggaaaaaggacatgcgactcaagctcaaacacgagcagttgatgaagcgaaaggacgcatatgtgttcttgaagtttgttgaggaggttcctgatcgcaatgagcgacagcaacgcctcatcaccatgttcaagaacaatcgctctgcgtggtctggcgcaatctttgaggatgaaactctcgcactgcatcgcaagcgcatgagtgtaatttcagcgatcaaacacgtagtgcgaacggacatcgaccgactggtgatgttcatggaggaaagaaagatcaacgttcggacattgcttttgaacgacggacaatccccgtatattgtccatcacggaagcgatattctcggaggtgtgaccgacgagactctggcattgatcgatcgaggtttcaaatttacgaagcaagaaacacttgacccactctgggaagagcaaagtttcatgctccataaatatgggtattgcattgaagttgacggtgaattcctgaaacaacagttcaataagcttgtcgaggtaaatcaggcctaagagccattcaaaaccgttaaaagcatagaaaacaggagatacacatgtcatttgcaaagttgaagaagagcagtggtagtttcgcagacctcagcaagaagctggctgacgaaaagaaaggtggtggacagggcaaggacgagcgttactggaccctgacgaccgatgaggcgggcaatggttacgcggtgatccgcttcctgccagcgccgggtgacgaagagtatccattcgtgaagctctacaatcacgcgttcaaggacccgaagacgggtaagtggtacatcgaaaactcgcgcaccacgattggcgaagccgatccggttggtgaagcgaacagcgagctgtggaacactggcacagacgcgaacaaggaaattgtgcgcgcgcgtaagcgtcagctcaagtacatctcgaacatcctggttgtctccgatccgaaggcaccggaaaacgagggcaaggtcttcttgttcaagtacggcgcaaagattttcggcatgatcgaaaacgcgctggagccgaagttcccagacgaaactccttacaacccgtttgacttctggcagggtgcggacttcaagttgaaggcacacgtggtagagaagcagcgttcttatgagcgttctggcttcgatgctccgaagccgctcttcgacggtgacgatgcagcacttgagcagttgtggggcaaggaatacagcctccaggctgaaatcgctcctgacaagttcaagagctatgatcagttgaagactcgcttccaggctgtcacaggacagaccggcgcaggtggtggttcgcagacgcgcgttgaccgtgaggtcgagcaggtacagcgtcagttcgatgagccgacacgtgaagagccgcagcgtgcaacacgtcaggcgcctgtcgcgcaggacgatgatgacggcatggacaagtatgccgacctcctgaagggctttgacgacaactgatcgtcagagtgaggaacaggacgcgacattcctttgatggggtgtcgcgttcctttatgattgtttgacaaattcggaggtacacatgggcattggtatcggttttctcaacattttgacactcatctttgtggtgttcaaacttctcggcacgatcacttggagctggtggctcgtcttcttgccgtcgatcatttcgtttggtatcccgatcttcttctggttggtgatgacgggactcgttcttcttggggctaccattcgatgacagctaatctaattctcgacctcgagacgctcggcatccgcgaaggtgcagttgttgtctcgcttggtgcgacactgttcgatttcgaaaagggacagaacgacttcgaccgctacatccaggacggcttccacgtgaagttcgacattccggatcaggtccgcaactacaagcgtggcatcgaagatggtacgctcgcgtggtggaaggagcagtcggaagctgcacgcaaaatcttgaagccttcggacgacgacgttacgatgcgcgacggactggaaatgttcaacgcatggttgcgctcgagttcgtatgacttcaagaattcgtacgtctggtcacgcggcacctatttcgacttcccgaagatcgaaagcatgtatgaccagctcgacttgaagtgtggtttcaacacttggaaaattcgagatgttcgaacattcattgacgttctcgtcggggttgacaacggcaagtatgagcctcagaatggcacgccgcgcaacttcgtcgctcatgacgcgttgcacgacgccgctatggacgcgttccgaatggtcgaaatcttccgcttgaatgcaggttccgacgatgacgacgccccgttctgaaattaaacgttctacctcgccgttctatcagtacacagattgggaagacttcttcgtcatcatccctcgcaggatcgaaggtaagttagtcatgttcaagatgtgtcagttccggcagaggtactacactgacaactgggcgatcttcgacaatgcggagacccagtggagaatcaaaccgtgacgaaatttaagacgtactgcatcgttaatcgctactacatgggcatccaggcaggcattcaagctggtcacgcgatgcacgcattggctggtatcgactatcgcaatcaagggcgattcgccgatgttgcagctctgcgcaacgagtggttgaaggacgctgaaggtatccctatgtgtgtcgtcaaggcaccgggtggtcatgacgccgtcctcgacttctacagtgacctcgcatatcagtaccaagaagtgtttccaatggcactcttcatcgaaagagcgaataataactctgcgtcgtgcatcgcagtcgcccttccggaagagtactgggacctcgaaatgttcaagacccttccatccgcaatctaactaggaaataattatgacagacgaagtgatccagctgcaactcaacgacccgaaggttcaagagatgctcaagaagggaatcagcaacctcagtgacatcctcacgatgaaggctgcacaacagtccgcgttcaatgaggcgctcaagaacctctcggaagagactgaactgccgaagaagttggttcgtaagctcgcgaagtcgtatcatcgtcagacgttcaacacggaagtcgaagagcacgaaacgtaccaagaagtctacgagaagatctttccagaagtctgatgaaagctcataggtggacgccgatttctaaaggtctgtcgatcatgttttgctggaagtgcggcatcatcaatctcaagaacgatgcatgtcaaagggtcgctgtcaagccctgtcgcggaaacgaagaagattgacatctgaaaaattgtgtggtactgcgggtaaaacggggtgcagccgaaaggttgacaccccgttccttttgtgtaaaaatttgcacaacatcaaggagacgccgaaatgcacaacgaactcgctcacgaagtccgcatcaacgtaaagacgcatggcctcaagttcgacacgcgcaacgcttccgaatcggaagtcaccaatgcgcagtacaatgccgaagtccggtggtgggaacaagccgaacagatcgcggagcagaacggttactacggcgtgcatgctgacggtcgtcagggcggatggttcgttgcgtactgtgatcgtttcgagatcgaccgcgaagcgcagttgatcgttgaaatcgaagcgcacctgaaggctgcacccgcgatcttcgccgccgaacttgacgaggtcctcagcgcatgaaattccaagactacctcgatggtccgatcccgcgcgacgaagagcgtcgcctcgcatccctctccaacctgaaggtgccgccgcgcgaaattgacggctggactttcaagtcgaggttgcacgcgtccgcccgcgcgtatcagcgttgcggcaacatcaccgaagcgcagtgggacaagatgatccgcgacatcatcgcgcgggtgaacacgttcgaccgactgaaggtcgagaaggaattcctgttctactccaagtcgctgcgtcagggcatgaccgtcgccgccgactatccgaatcgcgaaattcgcatcttcactgttctcgatcccggcaagtctgccgcgaagcccggaactcaacgcgtcatcatcgattgaggtacacatgatcatcagtgaagtgattgcagcccttgagaagatcaaggcagaagtcggcgacgttgaagtcgtcctcgaaaccgaacgcggcgcgctggatgtcgactccgtgtataccaacagctatggtcatccgtgggcgataatccgatgaacaacttcttccctttctactgccgttcgaacagcgacttcagcggttctgtcggtgcattcaagaaactctaccacgctacgcggcgccaaggtgtcacgtggtacaacgtcaatgtcgccatcctcgactcggtgactgtcgaattcaccgtgttcgagatgtttgacaacgtctacggcgggcgtggcgatgagatttatcgctacaaggggaacatccgtgacgaagacagggacgaaatgctggaacttctgaaggtccgcgcattgcgtttgggtgaggagcgcctcatcgaagaagaaaatgctgcgcggctcgccaagatcgcgagttatgccgacgagatttttcaggaggcgcttaaatagatcatctatcaaggtgatcaatcgatgacaaccgttctcacagtctacaatgacgacatcctcccgtacttgaagtacaacgttgcgagcgtcgccacttgggctgcacgacacggttacagctatcgattggagaagattccgaaggactttgatcgatcaccgcattgggcgaaaatcagtgtcgggatgaaggttgtcggcaacgagccgctcttcatcctcgacgcagatacgatcatccgtcacccggaacagaacctagagccattcttgcgcacaatgcgtgagaagggcagagtgctaggaatctgcgatgacgagccaaacggcggtttcatcaataccggggcgatgatcctcgacggtaacggcaagatgaagtcgttgctgaaagagtggtgggatttgggtccggaactcaatctgaactgggacaagtatcacgaacaggacacgctcgtctacctcatgcgccagaagcgtgtgaaggatatggtgcatgtgttcggtgcgcgagacttcaatagcgtttgcgacgactggcgtgctgatgagttcatcgcgcatttcatggcgaagtcgacggcagagaaaacgcgactcatgcgcgatctcagcgagatgttagacaagatctaactctccttgtagttgcagcgtcagtatgtaaatattggcacaatcaaaaacacacagacctcaggaaggagtttcctatgtcgaacacgcaaaaagccgatctggctgttttcatcgggcgttttcagccctatcacgttggtcatgagtacgcaatcaagcgtgcactcgagatcgcagaccgcgttctcatcctcattggcgacaccggtggtccacgcaccatcaagaatccgttcactttcgaagaacgccgcgcgatgatcgcgtctggcttctccaagaactcgggtatcatgttcgcccaaatcttcgatcatccttatactgaactcgagtggattactcaggttcagcaagtcgtgcgcgaacatcacggcgacggcgaaaaggttgttctcgtcgggcacaacaaagattcgtccagctactatctcaacgtctttccgcagtggaagttcatcgacaccggttatggtgagatgggcaacggcatcgcgcaggctatcgatgcgactgaaatccgcaagatgatcttcgacaaccgcttgcagtatgcgaccggtgtggttcctccggctgcaatggagacgatgatctacaccattcgccagaatcaggaaatcttcgatgcactcgctaccgagtacaagttcatcactgcctacagaaagtcctgggaaactgcacccttccctcctgtcttcgttacgactgattgcgtcgtcgtgcagtccggtcatgttcttctcgtcaagcgcggacagaacccgggtaaaggactctatgcccttcctggtggattcatcgatcaagccgaatctctcgaagactgcgcgattcgtgagcttatcgaagaaacgcagatcaaactccagccggaagtacttcgacgttgtattagaaccgtcaaggtctttgatcgcgccggtggagtaagcatggaagatcgcgggcgtatcatcacgcacgcgcacgtcatcaaacttgacgataacaagcctcttccgaaggttgttggtgcggatgacgccgaaatcgccgattggttcccgattggtgagatcaatagtcgtatgtggttcagcgatcacggtcacatcttccattcgtgcctgaaagaattgaactgaggttgcatccctcgagagttcctgttaaaatatcgaaaatctatccaagtcaaatagaaggagtttcttatgacgaacatcaatcccattctgctcactgacagctacaagttcagtcatttcatgcagtatcctgcgggcgccactgacgtttcgagttatgtcgaagcgcgcggcacgaagatcgaaggtgtgaccgaagtggtcatgttcggtctccaggctttcatcaatgaagtactgctcacgcgcatcacgcgcgcacacgttgacgaggcagaatcgttctgcaacaagcacggagtgccgttcaaccgcgatggttggatgatcatcgtcaacgagcatggcggttacatgccgctggaaatcgaggctgtgccggaaggtacgccggttcctctcaagaacatgatgatccagatgcacactctggacgagcgcctgccgtggctgacctcttacgtcgagacgatgctcctgagctacgtctggtacggttcgactgtcgccactctgagccgcgaaatcaagcgcacgatcaaggcgtacctcgacaagacttctgacgcgcctgatgcggaactgccgttcaagctgcatgacttcgggtatcgcggcgttgcagccggtgctggtggtctgggtggtgctgcacacctcgtgaacttcatgggcactgacactgttggtggtatcgagttcgcgatgcagaactacaacagcgatgtctgtggtttcagcatcagcgcatcggaacacagcacgatgaccagctggggcgaagacaacgagtacgaagcctacaagaacatggtgaaggcatacgcaaagccgggtgcaatcttcgcatgtgtcatcgacagctacgacacgttccgcgcagtgaagatgttcgcgaaggacatcaacccggatacgggtatgacgctcctggacgaagtgaaggcggctggtgcgaagatcgtactgcgcccggactcgggtgatgcgatccagatgccgattgacgttatcaatctgctcatgcgctacgtcggatacgagacgaacagcaagggttatgcggttcttccttcgcatgtcggcgtcattcaaggcgacggcatcgatcacaaggacgtagaagagattctgcgccgcatggaagattccaacctcagcgcgagcaacatcgcgttcggcatgggtggtggtctcctacagaaggtcaaccgtgatacgttcaagttcgcgatgaaggcgaacgcaatcgagatcgacagtgaatggcgcgatgtcgtcaagaatccggtgactgatccgggcaagaagtcgaaggctggtattcaaatgcttctgcgcaacaaggagagcaacgagtacgtcacggtgaagcaagatgaagggatgaagctgcgccgcgagaattggaattggtacaaggcgacacgtactgtctacagcgcacacgacggcaaggtttacgtcgatccggtttcgttcgatgaggtccgcaaaagtgcggcgctctaacaccccgccatactcagtacgacgtgacgcgatccttaaacggatcgtttcacttagtactccgagagatggatttccggcgctgtcaggtctgccggtgaacatcaagtggtgtccgcagatggagaagtccgatgtcgtcgggcgtgatctcatccgcatggtaaaggatggaattctcgtggcaaaacggacaggttgcgcaaaacctggatatccttcaaaatgtgtcacgcatcttgttatcaacccggactaccagaaatgaaaacttacctcgtcggtggtgctgtccgcgacagcctcatgggtgtgaagtcgaaggaccgtgactacgttgtcgtcggttcaacgccggatgaaatgatcgccgcaggcttcaagcaagtcggtgcggatttccctgtcttccttgacgaagatggaaccgagtacgcccttgcgcgcacggaacggaaggtcggaaccggataccacggtttcgtgaccgatcacgcgcccgacatcacgcttgaggacgacttgttgcgccgcgatctcaccatcaatgcaatggcgtttgacgaagacacgaacacgttggtcgatccctacggcggcgcagctgacatcaagaacaaagtgctgcgacatgtctccgaagcgttcgcggatgatccggtgcgcgttttgcgccttgcccgattcaaagcgcgctatggtcgcgagtggatgatcgcaccggaaactgtgttcctgtgccgtgatatggcagcatctggcgaattggatcacctcacgcgcgaacgcgttctgatggagttcgaaaaggctctgaacgagcgtgaaacttacgagttcttccaagcattgagcgacttcaatgcattgcacatcttgttccccgaactggttgaaactgactggtgcgtcggcgacgatcagagccgctctccgaagttgaagttcacgcttctcatggagcacttggcgggtggtgctgacgctttcgaagaaaagtacgtgatcaaaaccgagtggcgcgactaccggaagatgttcgatgcatggaaggctcccggcgattacgtcgatacgctctacaacatggatgcattccgcaagcgagaattgttccatgaagtgacggatgaattgcgcaatcaatacgaattgcaggttgcattccgcatcgcttctaagatcggatttgccgatctgacggcggaacaacgcgcaacgttgaagggtccggaaatcgcggcagctatcaagaaactgcggaaagatgccgtggagcgctatctgtctgattctgaaggttgacattcctcgaaatctctgtagaatgtcaatcatcggaacacacaacggaacgccgaaatgaacaagttcgatcacgacgaatcccgcgaagccttcaagaagttcagccgcgcggacatcaacgaaaccgcatcgatctacgagatcgcaaatccggaatcgtataagcgttcggttctaattgaaatgatcatcgacgccgccgaaaagtgcccgaacgactaaaaggttgcaagagttcaaaaactctgtatacttaaatcatcgaacaacggcacggaaacggatcatgaatatcaaagtcggcgacaaggtgaagttcaaggccactgatcatcagcactgcggaactgacttcgcacgtgtctgcacggattcgggtgacatcgaactgccgttcggaaccgaagctgtggtcgtcgaagttgacgattttggctccgtgttgaaggtcgggcgccgcatcgtgtatccgattcattcgtcgcaattcgaactcgtctaatctcaatggtgaacatcatgcgcaatgcacttttcaattccggttactggttcctcaagatgggcggtcactcgggtgtcgcactcgctctcggaacggcgctgatcactctgagcgtcgctggtgagccgaccagtgaataatccggtcgccaaacacgcacacaagttcaaccgcgcggcgacgcatcgtgatcgtaagcacgattacaagcgcaagccgaagcacaacaagcgagggtgggaatgaacaagatccttatcgccggaatcctcggcatcgcactgtctgcatgttcgaaacaagcgccgcctgccaatgctgaatcaagccaggcgattgtcggcgcgagtacctcgcactcctatccactggttcgtgacttcgatcccgagtacggaatcgtctgttatcgtgtgaagtacggcgaaggtctcgcgtgcgtcaaggtctcggacccgaagccgaacaccagcaactccgatttcagtgccatcaatccgccttccaccacggaatactgatcatgtctttcgaatacactcacagcgagcgcaccgtcaagaagtacactgtcggtcaggcgattgcatcggcagagcgcgtgctcaagtcgaagaacatcaccagcggcatgaacatgaccagcatcggtctcaatgccgaccgcaaggaactgatcacgctcgaacggctgaatcagatcgctgaccggctggtcgacgacaccatctactggctctgacatcatgaacccgctcttctggtatcaaatccggcgcaagttcaaaaagttcacgcctctcacgaagcgtgaggcgaagtacgtcttcaccgagttttacgaccgcctcactgccagtgtgtttcacaacatcaccacactgaagtggcactatggaatctgttcggctgtcgcggatgaattcaacatcgagtatggaaccgctatgcgcgccgtcgagtatgcagcgcacggatgggcggaacactcgggaatgccgtgcattccggtccaagccgttgaccgcgcatacagaacgtctctgaatgtcgaagatcccctgcgcgcgggtgccggatacctgatcaattggtccggcgattcgttgcgcgcccggaaggatctgctcctctacatggcatcgaagtactgatctagtatcgcaaaccgatacaaggtgacagggatttgtcatagcatagcaagtgttgtaattcttaattcattatgaggtcaccatgaaaaacgattccgcgcagaagcgcaagtacaccaagacccctcgctggaagaccaacgaagcgaagaattccggcgtgtcgactgacaccgagtattccagcctcgtggaactcctgaaggacgtgaacgaaaagctgcgcagcggtgcagttgacgacatcaccatctcgcgcatccgcaaggactgatcatgtcttacaccacgctactgggaacctaccacgatagcagctcgcgcgattgggtgatcgatctaggcgaacgcttcgacacaattccggaagcccgtgcgaacctgatgggcggaaacgacctgtggcgagctatggcttgcatcgttgagatcgatacgttcgccgttgtccaaggtcctaaggatcttttcggaaagagtttcattaccaagccggaagatatctacaacattgacaaaaacaacgaaatcatctactactatcttgagcggcgcggtgaagatgccgttgacggtctgaagtggtacagcggctgcggaacgtggtcggatgatcagagtgaagctttgaagttcatctcgcccgatcacgcgaccgcctgtggtgtgcaggttctcgaaactaccggttatgacacgtgggttttcgctggtcttgaagagaagaccgacacgaaggcggaaccgaagatcgaaactctccgcaaccagacgcagtatgcgtgggcgattcctctcgagtcggggctgtatctcttcgtaggcgcaactggtgaaccctacacggaaatcgaagacgcttacttctacgattctatcgatgaggcgaaccacgacacaccgcacttccgaaaggtgccagggtctgtcgctctgatcgaagtcaagaagacgctctcgattcagcgcatctcgtaacacgatccaagtagaattgtggcatgtttagccgcatgtcacaattcacccagtcagcggttcatcccgcttttattatgcaaaacatgaaagggatagccgtcggctagaagtagtcgcgacgtaactcgtgcccgagcaagtgcgtatgtgtttatgaaaggtgggagaccaccaaagagacctgctctgtcccagcatgacaacaggtgttactgacagcccaagtgtatggtggctgttttgtatggcgaaagtccagcgatggaccaaatctcagatgtctgggcgataccgctttcctcgtccacagccttgccgacacaaggtcatctgactacacgaaccgagccaccctatactcaggtgtcttgcacaattttggtgtggaagccaaattgtgccctcaccgcccaacctcaggaatttttatgaagatcgttgtgaagcaagataacgtagctccgtcgtatacttctctgttgaagtatgcgcaaaatgattccaacgatggaaaggttttccgtgcagaaaacggtgatcttttcgttgtccttcagggtcagcaggtcctgcaagtgactgccatcggcggtgatgtcattgtctacgacaccgacgcaaacaagaacgactactacctgatcaatgacatcatggtagaagcgactacccttaccgcaacactgacaatcgagtaatcgacatgaagctagaattcgctaaaccagaaaagaaaatggcaccggtcaagatcaaagatgtcagcccacgcgacttcgagtccggcgcggtcttcatttccgacgactacccgggcgagcgtttcatcttcctcctggaaggtgattggctgcgcgttcagccgaacaagaaagacgacctggaagcgggtaatacggtcttcgtcatcaccatgggcgatgaatcgcattacgacatctggggcgacgatctcgtcaagccgaccggcgaaaccgcaaagctggtgatcttctaatgtaccaggtgatcattggtgacatcgttattccgtgtgattccatgaatgccgtcatgatcaccttggacgaattgttcgatatttccgcaacagaccaggtcaaccagactatcgttcgcacgctcaagcaagagaacgaagcgatcttcatggttggagacaatcactgcaccgtgaggaagacgtaatggacgtactgatcggaattgcaattctcgctctcgccggttacatcctctaccaggaatggaagaagcgtcgcgacgatgacgaccaccacgatggtgaaggcggctacggcgttcacgcattcgcataacacaggagaacaagatggaaattacacgcacctcgccttttacgggcatcgttcgcacactcaacctcaacgtcactgacgatgaagtgctgaagtacatgtcgggtgtgtcgattcaggatgcgtttcctgatctgtctcctgacgagcgtgagttcattctgactggcatctcgccggaagagtgggacgcgacgtttgccggtgatgatgaatgatctacgccggggtgggtagtcgtgacgcgcctccttttgcttgccaactggctgtcaaggtcgggatgaggctgcgaagggagggcgtcctacttcgttctggtcacgcggaaggcatggacgaaagtttcgaactggggcacgacatcgcaacgcgtgagatgaactcgacaccttacaagtcgatctttctcccagaggcggggtttcgcggttcggattcgcaactcatcggtgcctctgtcgatgcgacattgacggcaaagcgaatccatccgaactggaaagcatgtgacaagttcgcgagggctgcacattcccgaaatgttcatcagatgtttggagaaaagcttgacagcccggtggactttgttgtatgctggacgcaggacggcgctcaaattggtggaactcggacggtcctgattctcgcagaagagaacggcattccggtcttcaacatgggtgcatacagcccttatgaggtcgccgtcgaatgcaaaaacttcttgaacaaattcttctaaggatttcagatcatgcttctcatcggttcgaaggctctccgcatcaatggtgttccggtcgcgcgcacgtcgtttgactacgatttcatcggcaccaaggacgaggtcttcgctttcatcaagagcgatcttgccggtcaggtgactgacatcaagatttcgaaggacggaaatcacgtctacgccttcaccggcaacgcgagcacgctcgtgtacgagttcgagattgcgtgggagggtagtgcaggcgaagcgttgctgcagatggtgaaggacgatccgtcgctcctgactgaaaacgcacacagtttcagcgtcgatgttgccggtctcgcagtgctgcgcgccctcaaggagagccacaagtacaagaagaacagcccgcatttccgcaagacgatggacgacgttctcgaactgcgcaagcgcgtgaagctgtcgaaggacatgcgcgcgtgggtgaagcaccgcgaagctgaaacctacaactacaaccacccgaagttgaacggcgtcggcaagggagaattcttctctgacgacggcatcaactacgtgtacgatcacgatgcgatccacctcgcagtgaagcacctcgaccgcccggcatacagctacttccagccggaaaccgagactatcggcacgtctaagggcatgttcaaggcactgccgaagagcgtccgcctgttgtcggttctggaagaggcgtatgtgttgagcctggaacgcagcatcatcccgttcgactcgttcggtgatgaggcgaagtgccgtaaggcgttcgaaatcgcgcttgaaaaggtctgcacgagcatcaccagcggttggtggcgtcagttcgcgtgggataactatcacactgttctcggaatgtacgaccaggagtatgtcgggcgtttccagaacgcagtcgcggcgggcgaagtcccgcctcatggacacgacaatgcacttcctatgtgaaacgttcggacacaaacagcgcccgtggtacaactacctgttccacggtcagatcaaagacccgatctttgacggcatacaaggcgcacaccgagacatctataccaactgtgatcgatgcggcgagagtttcatggtcgcgcgcgtgatcgatccaattttcagtggaaaggagaaagagtactatgagttccgcaagtgaaatccaagataagctcgacaaggcgtccaacctgctggaggaagcacgcaaactgagcatcggcaccaactaccatttctatttcgaagacttgggctacggcgcgggcgcggaacttcataacggcgagtggattccgtccactggcagttgctaacaggagaacgacatgagccttgatccagcaaagcgcgatgaactgaacaacatcgttcgcaacaagtacgccgaactgatcgacgcactcgaaaaccttaatgaggtgacgggactcgactacaaaatcgactaccagattaagccgggtgaggagtacctcggcgtatactggggtgacggcaacgaagacagcagcaactggaatgccagctggtgctaacaggagaaacacatgagtgatttcatcgaaacctatacgggcaagaagctgtggatgcccggcgtcacaccggaaatgatcgacctcaaggacattgcacatgctctgtccttggtctgtcgtttcgcgggtcacatcagtcagttttacagcgtcgcagagcattcgatcaatgtcgcattgctcgttccggatcatctgaaactgcaggcgcttctgcacgacgcaaccgaagcctacatctgtgacattccgacgccgttcaagcgtcagttgccgcagtacgaagcgatggaatgcgagctgcacgaagcgatttcgcttcacttcggaatcgatcccgtcctcgcaccggaagtgaagcaggcggatcgtatcatgctcatgactgagcgtgacttcctcaagccaggtggctgcaagtggaatgacgagtacgaagccaccgagcgcgtgcagagctggaagccgtccgggcgtcctgcggctgaaatccgaaacgacttcattgcgctgtaccaccactacaagacgctgaccctagtttgaccgtgtaaatactcagtacgcaacacaaacacaactgaggatttatgacggacaagatggattatttgcagtggctccagaaagaagaattcaagctggagaacaacgcgccttatgaaagtgacacggtggtgtggattcgtaagacgaagtactcgacgccgaagtgcagcacaaacggcgacatcatgattgcagtgacaaaggtcggtgacaacttcacgatgtcggttcgcgcttcgactccaaactactggtcgaatgtcgaggtttacaacctgacggaagaatacctcatcgcaaagggtcgtcagattgagcatcgtttggtggacgcatggcgcgagctgaaagtctaacccaagagatcatgcagtatttggctgcgcacagggaaagcgtcctcatggactcgcagatgcgatactgcggtccatgcggcggaatgaaggagacgaaagttttccgaaatccgaactgtgcgcatatcggaagattacttgatgaataccttactgcctctcacggatcgtgatgctgattacctggttgacgtactagatcgaaactgggaaatgtgtgaacatgtgaccgtcgcgaacgaagaattcgcgcgattcgaaatgacacgcgaacagcgtaacgcaattattcttcgatcacagtatcgaaacgacccgcagctcgttgctgcactgacactatttgggtgacacatgtctgacggttattcattcgtagacgcgatcaaggacacgctcaagggtgatttcagcgacgctgaactcgccgcgaagcgttacgacatctgtaaaggctgcgagttctttaagcacgcaacgttcacttgcgctcaatgcggctgtttcatgcctgcaaagacgaaaatgcgcggcgcgtcatgccccatcaataagtggtgaccatgcatcgtgatacctactttttcgacctgtgcgatgaggctatcgactggttgatccctgcaccgtcaacagaggaccaagacaaatgagaaacacaatcatcatctacagcgactacgaaggcgtgaacttcttcatcttggatggcgactgttcggagttcgatggcgttttcatcaatgcatatgacgacgaaactgctgagcttcaagagaagctaggtgagatcgtatacgacgaaaaaggcgtgtgcatcgttgaaatgttgaaccagttcccgcatgagcactactatcccggcgaaactgcggtgatcgttgcaggtttcattccgtaacgatctgtgataccatatgcaaatgaacacacgagtaatctttttccacggtttcggttccggcgtcgattccactaagtgggctgcgatcaaggcaatttccggcatcgacgcgcacctggtggaagcggactacgcgcatgaatcgttcgatgagatcatgcaccgcgcgttcgaaatgatcacgccgaacacgatccttgtaggacattcgattggtgcgctcttcgcacgcgcgttttcgctcacgatgtccctgccttgcatcttgttgaatccgtcctttgagccgcacctcactttggggagccgccttgaaaagaatcttgcacagtttcagttgatgtcggagacggtcacggaagcacgcggcactggtgagttcgcagttctgccgcaggagatcgtcctgtttgaactgggtgatgacgtggtgaatcatgacaccgtaaagcgcggaagccagcacagtgatcttcatctgttggagggaggttcgcatcgatttgagtcgttaaatatgattgcgaccgctctcagatggattgaaaatcgaccatggcaataactttcgaagactacctagcagaacgcttcgtcaacgtactgacatctccggataaggagcagtacaaaggcgaagtgttttctatgctgcagaaatcatacgcggctgtaggtggcctcaagggtggcggattcaacagcgccgacgacatggtgaagaacattcccatgtggaagatggtgcgcaagaacggtaacatcgtcgcggttgcaatgtacaaggacaagttcgggcgcaagcgcgttgcagttggctctgacggcagtccggaaggcaaggcgggcgtcgcatcgatcttcaaggaagactttgcacgcgcgtacttcgaaatcagcgagaagtcactcgcgtttcatgcgaagatcctcggttacgacttcctcaagaagtacgcaatgaagccgtccgacgttcgcaacatcagtcacgaccctatcgaacccattgaggctgacgacaaggaagcggctgcgcatccgcagttgaaggaattcttctaccgtcgcccgattggcggtcacttgcacacgaagattcttctcggaacacccggcaagaagattatcgtttccgaataaataccatcatcacatcaccgacaaccacaatgaaattcactgactacctacttgaatcggaagctgcagagcaagccaagaaaatgggcttgactgcttcgtcgtggggactttggaaggacaaggacggaaaggtcgttaagaagaccgttgacggcaagctagtggacgtgaaaggctcgcgcgcgaacgaagggcactatcataccaacatcccgcagagcaaagagactgaccacgacgccatcgacaacctcgaggggcacctggacaagtacatcacgccgggcacgcgcacaacaactgacatcacgaagtacggcacgcacaaaacgtccgcagttcatcccgacaaggcaaagcacttgcacgatgacctgatcgcagacggattccagtacgaaaaggacgacatctgggacacgcatcagtaccgcaagggaaacatgacagttcagatcagcgacaagccggaaacgtcacacaagggaggtggaaagaacgatcacctcagcatcgcgttctctgtgaatcacacgcgacctccgaagccaaaggctgcaccgaaaaagaaatgagatacaagaacggcgtcgacttaaaaatcggcgccgcttcctttactatgtactgacattatgatgaggttatacctatgagtgaaacgaatggattccagccgccaaagccaatggaagttcaaaatcaatcaaccggaaagcggtttatcccgacgatggacttgcctcgattcgacatgttcgatgactatgagttccgaacgccgaaagacacctaccaggtaatgcagttccagaagtatttgactgatgttggatatggtttcatcgcaggcggcgtcttcaagaacgcattcctcgggcaggagattcgcgacatcgatttcttcttccaatcgcaacaagatttcgaactcgctgagcgcaagttgtatgcggatcgcgggtatgagtttgtgtacgagacgcagcgtgccgttggtttccgcaacctcaagacgggtgtgatcgttgagctgatcttcatcttcttcggttcgccgctcgaaatcctgaacaccttcgacttcactgtctgcaaggttgcgatggacaagcaaacgctctacacgcatccgaagttctttgagcacctcacgctcaagcgccttgtgatcggtccgaagctctacaacccggtgaacacgtttgagcgcagcctcaagtacacaagatacggcttcgggctgtgccgtgagtcaaaggtaaatctcctgacctcaattaaggaagatgatctagcattcggcaatcttgtgaacagtatgtatagcggcatcgactgatctgcttaaatactattccatgctgggcggctcaggtcgcccagtttcatttgtagttggaggtaagaatgttagaacacgatattacggtctacagcaagaagaattgtccgccttgcaatttcactaagaagactttggaaggaatgggcgtgaagttcaacgaaatcgacatcgaatcggacgctgcagcacgtgattacatcattgaactgggatatcgtggagcaccagttgtagtgacacccacagaccattggtcaggtttcaatccagaccgcttgaaaacactttgattgtatatttctcaactaaatccgaaaacacacataggttcgtacagcggctcaatttacccgctgtgcgaattcctattttagcgacagatgaaattcccgaaatgtctgaggattacatcctcataacgccaacatatggcggtggtgaagtaaagggcgcagtccctcccgccgtcgttcgcttcctcaaagcataccagaataaagcgcgcattcggggcgtcatcgccgcaggtaatacgaatttcggagaagccttctgcatggcaggcaaggtgatttcgcgcaattgcaacgttccttatctcgaccgcttcgagttgaccggaaccgacgcagacttaaacagaatcagatcgggagtaattaaattttggaaacacaactgaaccacttagacttgaatgctaagttgaatctccctggaccgaagggcaggctgcagcttgaatcggacgcacaagccgcacgccagtacttcctcgaccacgtgaatcagaacacagtgttctttcacagcctagaagagaagttgaagtacctcgtagagcacgactactacgagcaagaagtcctcgacatgtacagctttgaggacacgaaggcgctctatcagcacgcctacagttacaagtaccgcttcgcaacattcgtcggcgcatacacttactacaagtcgtacacgctcaagacgaaggacggctcacgttacctcgagcgttacgaggatcgcgtcaccatgtgtgcgatgcttctggctcaaggtgatgtcaagctcgcgcgcgacatgatcacgggcatcatcactggcgcattgcagcctgcgacaccgacattcctcaacgcagggcgaaagcagcgcggcgaactcgtctcatgcttcctcgtgcgcgtcgaagacaacatggagtcgattggtcgttcgatcaatgaagcactgcagttgtcgaagcgtggtggtggcgtcgcattgtgcttgaccaacctccgcgaagaaggcgcaccgattaagggcgtcgcaggtatgacagcaagccctgtcaaggtgatgaagatctacgaagactcgttctcgtacgctgatcagttgggcgcacgtcaaggcgctggcgctgtctacatgtcggttcaccatccagacgtcatgaaggttctcgacacgaagcgcgaaaacgccgacgagaaaatccgcatcaagacgctttcaatcggcttggtcgtcagtgatatcatgatgcagcaggcagagaaggatcaggacttctaccagttctcgccatacgacgttgagcgcgtgtacggtgtgccgatgagtgacatttccgtcaccgagaagtaccacgagatggttgctgattcgcgcatcaagaagaccaagttgaacgcacgtcacttgctccagacgattgcagaactcaatttcgagtccggctacccctacatcatgttcgaagacacagtgaacgctgcatcgcctatcgatggtcgcgtttcgatgtcgaatctttgctcggaaatcctgcaggtcagcacgccatccgttctcaacgaggacctctcgttcaagaagatgggtgaagacatctcgtgcaacctcgcgtctgccaacatcaagtacatgatgcagtcgggcaagaacttcggtcacatgtgcgaagtcgcgattcgtggtctcaccacggtcactgacacaagcaacatcaagtgctcaccatcgattgcatacggcaactcgcgctcgcacgctgttggtctgggtacgatgaacttccacggattcatcgcggaaagcgggttcgagtacgactccaaggaagccgtcgaaatcgctgacatgtatcacttgctcgtcaactaccacacgttggtagcgtcgaacaagattgcagttgagcgcaacaccacgttccaaggcttcaagaagtcgaagtacgctgacgggtcatacttcaacaactacctcgacggcacatggaatctcaagccgcaactcgaggcagtcattgagttgttcgcagcacacggcgtcaagttcccgactcgcaaggattgggaagcacttcgcgacacgattatggagacaggtctgtatcatcgttaccgtttggcgattgcaccgacaggtagcatctcgtacatcaatggtgcaacggcgtgtatccacccagtgatggcgaagatcgaagcgcgcaagaacggtaagttgggacgcatctacttcccggcgcctggcttgacgaatgaaaaccagcacctgtacaagacggcgtatgaagtcgggttcaagccggtgatcaatgtctacgctgcggcaacgaagcacatcgatcagggcgcgtctctgacattgggcttcccacgcacggcgacgacccgtgacatcaatcgcgcgcaagcgtacgcgtggaagaaaaagatcaagacgatctattatgtccgcattggtgacgtagccatcgaaggctgcgaatcgtgcgcagtttaatgagtgaggaacgaatgactaagatgcaactgcaaagacccatcaactggaacaagatcgaggaccctaaggatctcgaaatgtggaaccgactcacgtccaatttctggctggacgtgaagatcgcggtgtcgaatgacctgtcgtcatggaacacgctgacacccgaagagaagatcgttgtcgagcacggcttcggtggcttgacagcactcgacggcgcacagtccacgattggtgttccgtgtctcatggatcacactcgcacgcctcacgaaggtgctgtcctacgcaacatcgtcttcatggagacagtgcatgagaagacgtacagtacgatcttctcgacgctctgctcttcgaagcgcatcgatgaaatcttccgttggacggacgagaacccgtacctccgccgcaagctggaattgatcaccgagaagtacaactccgacaatccgatgaagcgcaaaatcgcgagcgtattcctcgagtcgttcctgttctactctggcttctacacgccgctctactggtcttcgcgcggcaagctgacgaacacagccgacctcattcgcctgatcatccgcgacgaagcactgcacggatactacatcgggtacaagttccagctgtggtacaacgaaatgactgccgaagagcagcaggaactcaaggattgggcgtactcgttcttgttcgagttgtgggagaatgaagtactctacacagaagacctatacgacaaggtgggttggacagaggaagtcaagaagttcctcgcatacaacgcgaacaaggctcttatgaacctaggtttcgatccactcttccccgctgaagtcgcagacgtaaacccatcgatcatggcagcactcaccagcacaggtgacgagaatcatgacttcttctctggtggcggttcgacctacgtggtcggcacctcggaagcgatgcaggattccgactgggaccttgaattggacgactaacatgaacttagatcacatcatgatcgcgattgctgacggcgcatatgccgtcagtgatccaaccctccccgcactcattggggatgaagaatgagtctgcaagttggcgatgccgttgaggttgttcgcaagccaaccgaggcggagtatgagttgtgggcgaacagctgggaggacatcatggattccttcgtcggcaaaatcggcgtggtgacatcggtgcaattcgccgacacgtatggtgtagaagtcaacaacgattggtttttcccaaaattcattttgaaaaaggttgacaaacgctaaaaggtatgcttacccgggcaaaaggtgaggttgacggcggctgaattctgtgcaattattggcacatgaacaaagccgccgctaatcgttatctcgccgaattgggatacccggacctcgaggttgacaaagccgagggcgtgtattatcttatcggtggacatgaagatgaccggatcgacaaatctgttgagcgatgcttgaacgtcgttcgactgtctgatctgacgacatcggacctcgattggaaattgcgccaactgacgcagggcatttaatatggcacgcacaaagaaagttactggcctcaaagccgacttgatcgcgagcgcgactggtaagggttccgagcctcagtggggcggcaagttcgcacctccgagtaagaccgaactcgcgcgtgcgttgagtcactacaataccaagatgtacaaacccgacgatcacaaacggtgggcgttggaatggattcgtgccaatcatccggacgtgtacgagcgcgccgccgaacagcctaagtggttcttccacacgttcggtgcacttgcgcgttgtatctcgcgcggaatgcagaccgattcgtacctcaacggcaagatgcaggagtacatcaatcgcatcccagaaacggcgattgcggaaggtgacgcgcctcttttcgccgatgacggcacgccgctcgaactcgaaaaggaagagccggtcgcgaaggtgcgaaaggtccgcgagaacgcgatcatgcgcgcactcgatgatgcattggacagtgctgtcgccgatccgaacgcgaccacgatcttcgaagtaggtaccggtgatccgtcactcgcaatcgcgtattgcacggaacagctcgccgctatcaaggatgagccgggcatctatccaaagcacatgaaggcgtggttcaaggacgtgatcgaacgtctcgacaaggtgaagaaggcgccgaaggtccgcaagcctcgcacgcgaaagatcaaccctgtcaagatggcatcgaaggtcaagtacctgaagagcgatgcagaactgaaactcacgtctctcaacccgactgaaatcgtcggcgcgaaaaaggtctatctgtacgataccaagtataagcgcatcacgaagctggtggcgtcggcagccgcaggattcacgatcaagggcacgacggtgcaggacttcgatcctgacaagagcaccgcaaccttcttcaagaagccgaaggaagagattcgtggtggcatgggaatccgcgagttggatcgcgcgatgacgatgtccaagagcaagcgcaatccggatgcaacgggtcgcatcaatgaacacaccatcatcgtcaacgtgagctaatcgtcatgatcccacgcagtgaaatcttccgcactgtagtcgaaaacatccgcgagcacatggatgtcagtgagtccgatgtcagttactacacggaggaaacttccgtttatcgtctcgacccgcgcgagtacgacctggatgaaatcgacatcatcgaaattagcatggtgcttgacgatgttttcaatgtcgatactgaaaacgagcacgaagactggcagatcctgcgagatgtcgtgaacacctatcaccgcctttgtaatgaagatctccctaatccccgaggtaaaattgtgagcgaatctccgaagtacgaaaccgaaatcatccgccgaatcttcgacaacactgaaggcaagtacatcgaagtctcgcccgatgcggatcttcctgaactgattcgtgtcagtcacaacggcgacttctggggcaatttcagtttcagcgtcgaatccgacatggcgcgtcagctcgcacatgcactcctccgcgcagccgacgaggtgaaggcatgaagcattttattcttccggcaggcacctatttcttcggtgatccgtgctatgtgatcaatgacgacagcatgtgggacgaagtgtgtagcaacagcttcgatgatggtaccgcgcaaggcgttctcagcgacggaactcacttcgttgcactcagcacgtattacggcgacggcgtctacactggcagcaatggatacgcgtacggcgtcgatgcggggcttctcggtgcagttgccgtcgatcctactgcggctctcgacaaggaagtgacgcgcctcggaacggttcacacgttcaacactgaggtcagcatcgagtatgacgagaacacgggctacattcgtctcggtccggttgagatcgacacgaagggcaacgactatgaggaagatgaggaatgagaacacgcaatcacgattggttcgacaccaacgaccatagtacgaagtattcgtttcaggtcctgaaggacgagaagtggcataacgtcgctgaaaacggcaagccgctgctcttcgacacggcgggagagcgcgatgcgaagcgcgctgaatggcggaagatgaaggcttaaataaagggatgaaaccagtcccttacagccagatcaagcgtatcctcacaacgcgttatcgtacgggtggcaaactcgacactgacgcccctggtcagacgcaagtcgccaagggcgtacagccgatcaattccgtcatccaagatgcgcgcccggaagatgcactgcgagtcaccaagtccccacgcgcaacggcgatcctcgtaacgcctttcatggcagaggatcctgcgaacgcgtcgaagatgaatcgttatgcgatccgtgcaacgaaagacagcctcaacaagaacgaagcgcccttagcttctcacctgtttttctcggaagttttgaacgttaagaacccgattgagcgcgacatcggacttcactcgcagcttatgtggatgcgcggagccaagatcgtagtcgtctactcggacttcgggatcacaccggcgatgcaaaccgtgatcaatgcagcaacccaacttagtaagaagatcgagtatcgcactatcggcgcgacagcctgatactgttactttcatggatatggacggcgaaagaaccgccgtacaatagtatcactaccaacaatctatggagtgaatactatgtactacatcgaacacaagccaacacagcgtttctacacaccggacctcggtcagtttgacaaggctggacgcaattggcgcaagactctgggaacttcgtacccgacagagcatgacgcggaaactgcgcttgacagcgttctgaattcgcattacaatgagaagccgctgcgcatccgtgatcatcagggttacattcgtcagcgcgatttcgccattcgttccttctaatctggagcactttgaagatgtcattcgtttatcacccccgcgcaaacaagatcgcaaccagtattcgcggcaagcaggatggcggtacgcactaccgttatgacaaggctgtcaacaaccagcacgaccagtttgatgcaatcgatgtcctttccctgaatcatcgcgtggaccgctactactctggcgactacagcaagtacttcaacactctgacggcgaacccgaagagccgcgaaggtcagctgctgcagtacatcgcggggaagagctggtgagcaacgtcctcgacatcctcaaccaggtcgctgcgacaacgaagcgcaccgaaaaggaatcgatcctcaatgcacattcggcgaacgtaacacttcgccgggtgttcaagatggcatatgacaagcagatcatcttcttcacgaagactgttcctgactatcgcggtcctggtaccggcacaacgctggagcaggctctcgatgcagtcgaaagcgcgatctgcacgcgtcaactgaccggtcatgccgcacgcgactacctggaagcattgttcaagcagctctatgcggacgatgcggaagtgctcgcgcgcgtaatcaagaaggatcttcgcgtaggctgcacgtcgggcacagcgaacaaggtctggaaggatctgatcgacaagccgaagttcatgcttgcgcagacggatgcgaagaacatcgtctaccccgccttcagtcagatgaaggaagacggtacacgcgggcgcatgatcttcgacggtgaaacggcaactttcatcagccgcaacggcaacgaaatcgaaacgcacggtttcttcaacgagtgggcgcgccgcgaactgaaggctggcgacatcatcgatggtgagttcgtcgcattcgaaggcaagcgtcgtctcgttcgccagatcagcaacggcatcgtcaacaaggcagtgaagggtacgatctcgcgcgaagaagcacgtgaccttcggttcatttcatgggacattgattccgatgaatcgccatacaaggatcgcttcgcccgcctccagaaaatgctaaatagtaatgaccctgtgattctcattgaatcgcgcatggtcaactcgtacgaagaggcactcgagcatttccgcgatgcgcgttcgcgcaagatggaaggcacgatcctcaagaacgcgaacgcgaagtggcagggtaagcgcaccttcgatgtcgtcaagttcaaggcggagtacgaggcagaattcaaggtgacgggttacaaactcggaaccggcaaaaacgcggatcgtatcggcaacctcgatattgaatccgcatgtggcaagatcgtgagcgaagtcggtgtgttcaaggacttccccgaaaccgtccgtggtgactggttgaaggacatgccgacaatcgtgacagtccgctacaacgaacgcgtccttagtaagggtcgtgcaacttattctctcttcctgccgcgagtcatttcggcacggtgggataagacagaagctgacacactggaggaaatcgaagaaatggaaaggaacactctataggaaagtattccaatgccgcaagtataccaagataagccagttggcatcatgtatgtaaacgaggatcgtaacctcctcgtagtcccgaaggttttgcgccagagcgttctcgatgaaacgccgttcgatctcgaccactttgtctactatcactcgatggtacctgtggacgtgaatcaggacggtacgcagacgatcatgtgcgaaggacgttcgatcactctcccagctgatcatttccgaatgatcgcgaaggactttgaggacgacatcaaggactacttgtgggatacgcagtcggttcttcccctcgacgtttcagttggcgcatttgtgtctgacggttgcgaagagccggaatgcatgacgacactcttcagtgttgaatactctttccatcctgatttcgatgagcagtgcgccgtgtgtacaatgcacaagaagcacgcttatgacttgatcaattttttgaacggtacgaccttcatcaagcgagacaatctcttgcaggagaaagtgccattcattcaagtgaatctcaagcaagctatcttcgttgccgattcatcagttcagacgatcctcggttggttcgttgacaacttcagtgtcacattcaagatggcacgcattaacgcaatcacattccgtgacgtgaaaagtggtatcccttacacaacgcaaattattggagattgacacaatggcttatgatccgctgaactacgtgcgtgacgacgtttcgccgcgcgcatttgaactgttgaaggaactgcaggaaaagctgaaggcgccgacgacgaagctggaagagatttcgaaggctgagtcggagcagattgaagccatcacgagcatcagtcgtgacatcggcaggcagcttcgtgaggtcatccaggagagcgaggatttcgaggatcaggaagaagcgatcaatgaaacgttcaacgaactcttgaacgaagcgattgctacgacgagttacgtcgcgaatgacgaatgggaaagttcgaacatcgatgaagtgaacctctgggtgccttcgacgtgctaaaaactgccatcctctctgaggacggcgtgtacagatatcttctcacccggcagttctcgcaattgctgggtgagtcgctttcgacgccaaagaatgtcctcttcatcggagtgaacccgagtacagccgatgcactgaacgatgatccaaccgtcaagaaatggattggattctcgtcgcaatggggctatgatatgttcactgtcgtcaaccttttcgcgtatcgcagcactgacgtgaaggcgcttgagcgcacacctgatccaatcggtcccgagaacgatgcgaacatcatcaaggagatcgagcgagctgacctcatcgttccatgttggggatcacgcggcaagttgccgaagtcgcttcgattccgcatcgatgatgttctcgcaatgatcggtgatcgaaagatgcagtgtttgggcgtgacgacaagcggcgatccagtacatccactcttcattagctacaagacacctctgacagattatgcttatctacaccagcaccaagtacaagccgaagcgcaagtcgaagaaggcaaagggcgaaacgttcaaacgcgctccgaaggcgaagttcactccgcttaagacgcagccgtatcgaccagtgagttcaactgatcatctcaagtcggttgacatgcaggcaccggtcctcgcgcagcctttgaagtacgaaggtgagatggcagagcgcgaggcggttgcacaaaaggaaatcgagcgcaagaagacgatgaccgcgccagtctacaacaagggcgggtatcagtacgtcggtgacatgccgcccgaaatcatcaagacacttggtcgcaaagtgtaaggaactgtatcttgaaacgaactacttctcctgtaaatactagtatgaaaaatattctacacacagcatcgtatctcattcccgtctggcagaagccggtcggtgggtttgtgcgtttgcaagacggttttggtggtgggtaagtagagtaggctcgttctccttggttggtggtactccaagagcctgcagaaatgcgggctttttcgttgttagcatccgaggttgacacgcagcagaattcgtgtacaatgggcacatgaattacgggtctatagcacaatggttagtgcgctcggctcataaccgatgaggtgaaggttcgacttccttctagacccacgcatgaaagtttggatcaaacagcaccacaattttctgattgactcatatcgctacggcgaaatgatgcttgacaaggcaaatgatcgtgttataatcatctgccctgatacagacaacgtgttagtggactgttcgaagtcgttctatgatgccgaagtgctcgcaggacggatagttggaaataaaggttgacaaggcgctgattcatgctataatgggcgcacaaattcacgacgcaacatattgagatgttcgtctagttctgttaaaactcaggatacatggtgagagcggaatgtcgctcggtggttcaatcccacctatcacctgacggactgccaaagtgcaggatcacattcgatcagcgggtgccgcgccgtcagaaggggaacgcaagttctctggtggtatggaatcatatgcgcatggatcgcgccgcgagggataacgccctcaatctggacaagcggggaagtgggagagtctcagcgggctgtaaacccgccgccttgacggctgagttggttcgaatccgaccttgtccaccaaattctaaaatgatgccgggtagctcagttggtagagcaagcgaccgataatcgcttggtcgggggttcgagtccctctccggcaaccatttctatacgtcgctagctcaattggcagagcagtggattccaaatccaccggttgagggttcaagtccttcgcggcgtgccaacatcgtgtcacagatagcaggttcacctggaatcgaaggtgattgaacggtcatttgcaagatgacagcctagcacgagacacgaccatgcagccttagcattgagggtcaatgcgtgcgcctgaagagcgctagaactcggttcgatcccgagaggctgcaccaaatcgagacgtgcccccttgcacaatcgcctgtggtaatcagagccagcaggagtaacatcgcgtattcccattgtggtgcgcgaatagggaatcatttagcggattagctcagtcggtagagctcaagactttgaatcttggtatgcgaaggttcgatcccttcatccgccgccaaaatgtcaatgacacacgatgtcagatgactccgacagtcggacgcctgaaggtggcgaaaaggatcttcattcatgggtcggtagctcagttggtagagcaggggactcttaatcctcaggtcgtgagttcgatcctcacccgacccaccaaattcatgcgggtttagctcagttggtagagcatcaccttgccaaggtgaatgtcacgagttcgagtctcgtaacccgctccaatcgttgcaggtgtagctcagttggtagagcgtcgtccttccaagtcgaatgtcgcgtgttcgaatcacgtcacctgctccaattctcaatatgaggtcgtcatgatcaaggtttatgacaataccggcaagttggttgcaaaggtacacactcatcatcgcgattttccgctcatgattcaggacaattgcaaacagatcaaattcacagatggaacgcgtggatacgaagtcgaagttggtttcactttcggcgacgggcgtcacatagactttctgttcaatcctggttacatgatcagcattcagtaaaagaattcgttacacgcagttcatagtgtcgtcgtgaaaagctgcgcagcaacatcatcgtgagtttctagaggctcacgtgaaaaatgatcaatctggacgaaggagggttcgagtccctccgggtcattaatcatgatgatgctatgaactgcgtgtaacgatgttatggttgtatgacttgaagcaaaggtcattcggacgcgggttcgattcccgccatctccaccacatgcattttcaaagctcgcgcgaggagcattcgtcgtaaggtcaactcgcagaggctgacatgacggaaagtgcaagtgatggggatgcccaggtttcgacgggtgaagatagtagagatgacaactcgccgcacagtaacataaggcgttaaacaggttgcaaaatagaatatctgcaaacgatgattcttacacggtggctcgcgtagcctaagtctcagacatctgaccttctgagttcctcattggtcggctgttttcggtcagtaaaaccgttcaaattcaaatgctgatagtgttagtaggcgagcgcacgcattggagcgtgtaggcagtgaaagcatcaatcggagcagtgatcacttatcattgggacgccagggacttgatcacggatctattcgacaggctgcgataacgcgccgtcaaaacgagtgcggaggtcgccggttcaaatccggcatggggctgcggctcccattagctcagtctggcagagcacccacacattcgggggagtacctcagagaaagaggaccgcgcgcaagcggaagtcggtggttcaagtccatcctcccccaccaaattggacttgtagctcagtcaggtagagcgtagggaatgggtacgcgtgtcgagaacgctaatactcacccccgcaagcgtcgatggttcgaatccatccaggtccaccaaaatcaccggggtgtagagcgtagtctggtagcgtgcggcgtttggagcgccgagccgtaatggtcccgcaggttcgaatcctgtcgccccgaccaactttggacgtttagcttaattggagctcgaagtggagccgacgcgcaatcggtgatgaaactttggagtagcggatcgcgcgagaggcgaaaataagaccgagtgggttaacacgcagagtccaacgacaacttctcaaacgacgaggaaagcttgcagtgaaaactgcaaattagaggttcgaatcctttaacgttcaccaaacaatggcgtgagtacgggatctgcgtctatacaaaccaagcccgaaattttcgaaatgaactgttgtgtgaaagtcaccggagtagttctctaacgtagctaggcgcagcccacctattgcaggcatgccgggtcgaaggtgcgagtccttcatacgccgatcaaggcgagaatcgaaaagactacatcatgaagcgcatgatccaatctcgagtgaggagattgtgttagtggtcggcaacagtactaattatccgtgtttagctcagtttggccagagcactccgtttggggcggaggggtcgagggttcaaatccttcaacgcggaccacataaatagcatggtcaatcatctaaatgaaacgatcatgcaaacggacgaaaaactacttcaagtaccgccaacaaagcgtcgcagatgggaactcatcactgcgttcaccgcttgctgtgtcggattgttcttcatcggtttctcacttggcactgtgacaacacgcactgccgcagtcgtagaacgtgaacagttgatcgtctcatacacacacgctttgaactcaaaggacgcgctcatcgacaacttgacacatgcaacggtcaaggcgacagatgcagttcttgaatcttcatcgcagcagcaggaccgcgctaacatcgcgattggaacgactgaagagaaagctcgcatcgcccgcgcggaagctgaggcagctcagaagcgcgccgctcagattcgagcacaaacgcgcgcacgtgaagcacgtgaacgccgcaagttggaggaactacgatgatcaagtatctagctattgtcgtcatcgctttggcaatgtcgggatgcgtgactcgttacgttgaactgccgcctgaactgacggctgatatggaaacaaatacacgaaaggacgcttcactggatgaagctgtcaacctggcgaacaagcgtggcgaagtcatcatcgatggcaatgatcgcttccgtcaaattcgcgaactgcaagacacgaaagtcaaaaagtcgaagcctgcagaagaataattgcctctgtatcgccaccggtttctacccggtcgttaacagcgtaattggagtatgtgggttcgagtcctgccaggggcgccaaattgacaaatgcgcggatcgcttcatcgcggaagaacacacggtttgtcaaccaaatgtagcatgctcgcaaagcggagtcgacgccgccaagtgagttattcctgaaaggtcctgatccggaggttagtaaccggatgcgagtgaggtaggacttatgtggtcatgaacgcatatctccgagataacttgtgaatgctaagcaattcgatcaggctgcattgtgcgccgatcaatcaaacgttgcagcgcgaaagagcctatgagtggcgttcgcggtctcctggcagaggcgaagtatgaagtgccagcttcttcacggactgtaatcaaattcttcacggcgctgtcaacacatcaaagtcgctatgaacacagatcgtcattctcgttagaaaccctgttttccaggtgttctggttgtaaatatcagtacaacctattcaacgggagaagggtaatgacagacaagaacgaaaacaagaaggacgcattcgctgatcagcgtgaacaggcagaacagcgtaagcgcgaacagcagggtacgcagcacgtcgatggcacgcgtcttggcgacaagacagcagaggccagccagaaggaaatcagctcgcctgaactttctgacgacgcagcaaaggctcgtgacagcctctacctcggcagcaacttcaacgacatcaacgagcctggtcaggttgacggcgatgcagtagacccagagtctggtgtcctcggtacacgtcagcgtgaacagatcctctctgcagaacgtatgctcgcacagcgcgcagcacgtgaagcttacgcggcaggcgactcgacaacgatgcgcaaccgtgacaaggcagagaaggacgtcggtaacggctacatcgcggcaacagttcctaacaaggaaggcgatgcagctccagacggttccgatcatacagtcggcgtcgactggttcaacaaccgcacagtcacaactgacgagtggttgaagggtccagaagacttctcggtaacagaaggtcgtctcgcagcggaaaacgcttcggacaagacaactgatgccaagggcgacaagatcaaggacgaaaagaacaagtaattgttcggtccttatagcaacaaaacgcacgcgccttcgggcgcgttgcaatttgcccgggtggcgtaatggcagccgcgctgcgcttagaacgcagtcccgtaaggggtgcaggttcgagtcctgtcccgggtaccaaattagagagttcagtggtgtggctgtgatggaattggtagacatgtctgattgtgaatcaggattttgcgggttcgacccccgtcagtcaccccactgaactcttaaatactcgtaacattcacgatcaggattcacaatgaagtttgacgagtacatgaccgaagccgaaaaggttccggcagtagaaaaggaagcgaaatctgctgtcaaaaaggaagtcaaagacttcgaaaagacactagacaaaatcgtcaagcttctagaagaacttcgcacacatggtcgagcgatcaacaaaaaggttcacgatgtcccttcactgaaaggcaagcgcatcaataatcttgaacacccaagcgagttcaaagtttcggtttctgctcaaagcatggatgaagctgcacttgtgctggtaagggaagtgaatgaaatccgaaagggattggctcgactcaagtaagaatttgccggtatagctcagcaggtagagcagttgccttgtaagcatcaggtccccagttcgattccgggtgccggcaccaaatcatatgggcttgtggcgtaattggtagccgcgctagaatgagagtctagtgggagaaatcccgtgctggttcgagtccagtctagcccaccaaacaaggagaaagatatgttcggtaagatcatcaaaggcattgcttcaatcgcggtcattaagtgggctgcaaagaagttcggcggtgacctcaaccataacggtttcttcgaccagaagagtaagccgaagcgtcgcaagacaaaggcttcgaagtaatgggctggcgttgggaagttctcgcttgggtgatgaacactcaaactggtgagggctatcacgatgaagccgtataccagggcgattcaatcttcaaggcgctgatggctgtgtaccacgcccgcgcaatcatgaagagtggatgcgtcacgctgcgttatcgcggctaataggtatgtcccagtggcgaaacggtagcacgcagcagacttaaaatctgccggagaaatccgtgtcggttcgagtccgacctgggataccaaacttaaataatgagtatgacaattgatgaattgagagactacatcgcatatcgtgaggaggtactgaaaaagtacatcacgagtcgatggtacgatcagagcaaacgcgacatcgagctattgaaggctgagttgcgtttgcgcgaagaacaacagtatattgccccgtagttcaatggtagaacgccacgctctgaacgtggtaacatcggttcgataccggtcggggctgccaaatatgagcggtgaggtgtaatggttggtcaagggtagctcccatgacctgcacgtccttccctaagaatgaaggtccccagtgaaagttcaatcgaacacgtgatagtgcgaatgattaactgcggtctacagggttcaattccctgcactcgctcccagatatatgctcggttagctcaggggtagagcggcgtctttacacggcgcgggtcgggggttcgaaaccctcaccgagtaccaaattttaggttgacgatcatcgtcatccatgtcataatgagcgcatagcgcaatggagattttatgatgaaggctttgattttcgcggtactgttgtcgatgtcgctcaccgcatgtggtgaaaacacagcaacgattccctctgcatctgcaatcgaacagatccactcttctgcacgcgtcatctgcggtgcattgaacagtgaggtctcacgtgttgcatggaaggaccctgcatactcgtactatcttgaagggaggaacaatgatggttttgtcccgatgagcgtcgtgattcgatgcgaagatggttcggtgcatgaattcaagttcgatgcgacataccaagtgtatgaaacggactacgtggattaaacaaatacgctggattggctgagtggtcgatagcaactgccttgtaagcagtcgggaaacccgtcgtaggttcgaatcctatgtccagcaccaaacaaagagagaatgattatgcgcgtcgatgaactgattgctgaacttcagcggcttccgtcagacctcacggtttggaagtcgagggatgatgaaggcaatggctatgaggaagtagaacgtgtcgatttgaggttcatgcgaactgaagagcttgaacagtggcaagttgaagaggtttactcggaaggctgccttgaggatctcgaaatcgagcgcgatgaagtgacggaagtcgcagtcatttggtaaaagatatgcccctgtggtggaactggtagacgcaccgcactcaaaatgcgacggagaaatccgtgtcggttcgagtccgaccaggggcaccaaacatagagaatgatcatggtcttattggacgattacgcggttggagtcgctttctccttttgcgtcgcggcagttctacattgtatttggtggactgcttcgtggtttgatggcgacgggtttaccattgaacaagtgttagcgagtgttctcgtaactaccgtcatttgcttgatcccgtttgcaaacgtagttgtaacttgtatggcgagtgtgatcatgacaatcgggcttctaggggctggttacgagcacttgaaggaacttcgcaacggaaaatggggcgattttctaacaaaacgtagaggtcgcgaatgatggaattctatttcgcaacagtgctgatttccctcgcggcaggtgcagtcctcctaggatggtatgcccttctaagctactacgctcgtcatggtttcacgctgttagaactgctcaaaggaaccctgattggtctactggtttgttttactccgtacatcaatgtggttgcgatgatttccatggctctttggctgctcattgacacatgcatctgcatctgggagtggtttgagaatcgcctgagaggcaagtggaaaaatgttctgaacaaaaaccatcgtcatgggtggaagtaaatacatagacacgtccggttagctcagttggtagagcgcctgctcgacacgcagaaggtcatcggttcgaacccggtactggacaccaattctaaaggaaatgatcatgcttatgtttgggctgttgacgtggatggtcggcattgccggtttcatcatgttctcttttgcgaagtacatgtggagcggtgtgagcgttggctatcttctcggcatctttgcggcgatgacagcactctctttcatcccgatcttaaacttctcagtttggctgtcggcagttgcagcactagtgtttctcctggtgactctgtaccgtcgtcatctttctgggtcatcgttcgaaggcttcttcaagcggtcttttgttccggcagcgccagtcgcgccaaaacgagacaggtggtgagttatgacagagcatgatggcggatatacacctgcaaacgtctacaaggaacactcaacgccaaagctccatgcgatggctgagcaacagttaggcaagggcatcaagcggatgcatgtaactgctagtgccgatgcaacaccagaacaagtagaagccgaattcgacaaagcactgcaccgaatgaaacatggtgcattcgtcccaatcggtgaaggctggtgggagactgtcaagggacacctccgcgtttggcgattccgtttcctcacattcattggagtaatcaagtatgttcggtctgcttagtgctattggtgacatcgctggttccgtggtccgcgtagcggctgcacctatcgcgattgccgcagaagtcgcaacacccctggtcgaggtcgccgctgatgtcgtgcgcccgattgcggaagttgcaggtgaagtaacagattcggttcgcgaagcggtccgataaaatcaactatcgcgggatagtttaacagcagaatgctgggctcataacccggagatcgtggtgcaactccgcgtcccgcaaccaaacaaggaaaatgatcatgagtgataacgcgcaaattatcgaagatgcaaagctgaccattgccccggtcactgaatacctcgaaaagaaccgcaaggaaatcgctgacgttgaaacgcgtcttgcagttctgcgccagggtctagagaacgtgttcaacggtcaggtggaaagtgcaatcgattctctgcaagtcatcgcgtatgactacgaagatggtcaagaggaagccgaacaaatcctcaacagcctgaccgagaaagtgaacaagcttggtatgggtatcggcattgaaggtggttacctctggatgccttcgactcgttcttgctaagataaccgccaggtagctcagttggtagagcgcgctcctcataagggcgtgtgcatcggttcgatcccgatcctggcgaccaaacatgtcggcgtagcagagtggctcatgcggttggctgcaacccttcagacgtcggttcgatcccgaccgccgactccaatagaggatgatcatatgtgcgtagtttcaatgattggtgagcattaccacggcaagtggggcgacaaggtcattccaatgacacctggtcgtattccgactcccgtcgatgaccttgaacgttttcagagcatctggacgtcaccggtgacacgtcaagagttcgatcagttgaagcgcgaagtgcaggagatgaaaaagctcttggaacgcgcgcataaatacgacaaagacaccggacaggcagactgtcacgtcgatgagaagatggcaacgttgcgccgcatcgcggaagccgttggtatcgacattgacgaagttttgaagtaactaaagtatgcccctgtagctcaactggaagagcaggtccctacgaaggatcaggttgttggttcgactccaatcaggggctccaaattaaaggttgacactgcagaaaaatcgtgtataatgaacgtatggacgtcatcatctacgaaaagcctgacagaaaggaaatcgatgcgatgatcaagttgatgcagcagcgcactatcgaagcatgggttgagccaaacctgttcacgagcaagcaccatgaagctcgagttctgcgcgcaaaggcacggaagaatcgccgtaaataaacacatgtagagttagccaagcggtcgaaagcaacgggctgttaacccgtcagagcaatctcatcatcggttcgaatccgatactctactccaaatccgttcctcgatagctcagttggtagagcgctcggctgttaactgagtggtcacaggttcgaatcctgttcgaggagccaaacatagagaatgatcatgaagcttgttccttttgttgttcaactcacgaccacgcggaagtttcttggaccacgcggatgcgcagaagagtctgcagttgacgcgcgtcttttcgaaacagaagacgaagcacgggaggcgcgacgacagtgcaatgatgtctggcgcgaacgcgccgttgtccgacagttgacggatgaagaggtagatcaagttacatggcactacaatcgaatcgcgaatcaagtcagaaacctggcgacgtttttcgagtaacacattacgcggtggaagtctcccgggtggagatgccggattgtcagtccggagatgacgggttcgagtcccgtgcgccgcgccaaattcgggtcgttagctcagtcggtagagcaggggacttttaatcctcaggtccagggttcgaacccctgacgacccaccaaacaagatgtaactcaggtcgatgacatgatcacgtcttgcaataatagacgcatcaagtaggagatcatgatgaaagattttgcagatgtagcagcatggattagcagtgagttcgatgtcgattacaacagcgtccttgagacgatggatgacgaaggactcctggtgccggaaacgtgcgcaatcaccttgtattctgggtatggacgtgactacggttacggaacagatctaactgaatggattgatgcgtttgtcgcagaacacggcatcacagaaattcttgtgtaaatagtacatcatcgggggtttagctcatttggtagagcatctgctttgcaagcagagggtgaagggttcgaatcccttaacctccaccacaatttggggccttagctcagctgggagagcagttgctttgcaagcatcaggtcatcggttcgatcccgataggctccaccaaattcaatgcacctgtatacaaattggacaaagtggactgactttcaatcagttgccgaaaggcgttgcgggttcgagccccgtcgggtgttccaaattagtaagtttttccggaagtgttagccgagttggcctagcggcggcggtcttgaaaaccgagggtccccgggaggggacgtgtgagttcgagtctcaccacttccgccaaattttgatgatgagtgtctatgaaagagattgatgatcaacctttgtatgacgcgaaagcaccgaaagaatactttcccttgaacatcatgtttgaaggtgaggcgtcgaaggaatacagagacggttgggtgtttgcggataaagtgtggttgaagtacgattaccccgatctcgcggcagaagcacctgatcattggagcgacgaaaaggcaatcggattttgggatcgcctcgcactcgagaagagagtaagaaacaaagaaggtggtccgtgcagttgctgtcgcacattcactgaaaggcgtgactttggaagtggcggaccatatcgatgcggttctcaggaatgcatcatgttttgaatatcaggcgcaagccgagttgtatgtgtgacagcctgaggaagtaggctccgatcagttggtgttcaatggtagcacgcccgccgaaagcgggaagagcggttcgagtccgcacggagacgaaaagggctacttgattctacagtccgaagtacaaggatgctggggattgacggcatacggcgagcttaattgaaggtgatcagatgtttcatgattacgacgggtggggtgagccaacacttcgacagtggaaggcgctgaatccggaagagtggtctcgtctcatgcacgagatgttgcacgacgatgcgaagcgaaacggcgacaaaattcgccaagagttccatgcaggtaagttgagaacgatttcagtttaccggcaggcgcgagcagagcaacgattgtgggacatgggtcttggatattgttccatgcatgtgttgcgctaattgacaatcactgtataatgggaaggacaaagcgatgacgaacacagtaaagtttgaagtgccggcagacgtggttgaacgatggaagcgaaacgcaaccctcgaatgggatgaggatgatcgcgaagagaattatatgagcgcggtcacatgtggtaacgcagacgacacatacgccgaaggtgaagagcagggtgaagcttcgacataccgcgaggttttgagctacgttgtcgaataatttgggtgggtgtggcaaaagagttctcggacttaaaccgagtggtggagggtgaagcaattcacccctacgtcaatatgaaggaaatcgggtttcatattcccgtcctcgttcttcatgttgacaatgcggaggtcactgatgacgctcgccgcattagaaatcagagcagaaaccttatagaggagtcgttgccctataaggtttggtctagcacctcgggatgccgaaaggcgctcgttgagagaaaaggtacggtaacgtgctgaatggagaatgcgcccacaagcgctccgcctgaaaaggtctcactagaaatagccagcatggtggcaccgaaaggtgcgtttcgagattcaagccctcggaactatgtcggatgaggtggtgttgaaattcacgataaggccaactggtacatcgtgatcggggttgctcccgataggcacacgcaaacaccgaaacgaaggatcactgaactggaggtggcgtagttcgagtcttagcgggcaagagcgggtcgcagatgtaatggtgggaaactgccgtgtaatcagtacgaattgtaggcttagcggctgaaaagtacagggggtcgggtaagaagctgtcgctcaaaaggcaatggacttacgaacctgctcgaccctagtgggttagctagctcaattggtagagcaactgtctcttaaacagtcggatgggttcaaatcccaactaaatcaaaagcaaagccaggttcggtcgtagttgaaagtcgcataatacttcactcgcaagagaatgaagtcatcaggagactcgcaaggttgaatgatgttggtgaggagtcgcacgtatggggtcgaacccttaggagctcgcaaggctcgcggtagatgagacgccgaatagactacgatgacacaggtagtgcctcctgtctaaactaggctgcgacggtgatggacgtgattgtgtccgaaaggatagattacgtggacaagtcgggaaaatggctcgcaaggccttataatccgaacgaaggcatcatcatgttagcgtgtaatctcagcgcgaactcaaaggcagctttgatatggtattcaaatgtcatatcaaagctgccttcttactatcataatgaggaatacggaaatgcagatcacaccggatagcatttacattatcaaagaagtaatcagtgacatggcgtcgtggtggaatcaagagctggtccctgacgatgacacgcagagagaattcatcgaacgcttgtgcatcgcaattggtcttcccgtagaggaaattctcaatgcataagcaaacaggcttcaccctcatcgagttgatgatcaccattggtctcctgatcacactcggcttaatcggaattgcagtgatcgttgctatcatcgcattcctcttctaaggaattgtcatgcaacagcaaaagagcatcgatgcagaggaactgcgcgagttcatgtcgaagatgggtcctgacacgaaggtatacttcggttgcgactcagagcgttttcagaaagacggtaagtggttcgccgactacattgcggtgatcgtggtgcacatcgatggttgccgtggttgcaagatctttggtgaagttcaccgtgagcgcgactacgacgaggacccatcgaagccgttcactcgtatgatgaccgaagcgcgtatcgtcagtgacctgcacagccgcttcaaggacgtcttccacgatttcgaaatctacgttcacttggactgcaacccgaagaagacagccggatcgtctatcgcagccgacgcggcagcgggttacgtgcaagcgatgacgcaggtcgcacctcagttgaagcctacagcgttcgcggcatcatacgcggctgaccgtgcaaaggaaatcggagtctgtcagtatcatcctgcggggtaatcatgagcgagtacaactatacgcttgcgtttgagtaccgatttcataagtcggactacagggaaaatgcggtgctccatcatggaccgaatgtccctcttgtacctcgagtaggtgaaagtgtatcgtatcagtattggacgggtgaagtgttttacgtcgaatacgggtatcatcaaacaggtgtgcatgtgacagttggcgtcaagctagggaaggaagttccgcttccgaagttcaaatgaagacgatccagatcctagagcagttcgatgtcattcaagcgggcgacttcacccgtccgctcgacatcatgtgggacggtgatttcttcacgatgaccaatcagtacagtggcactccgatgaactatactgaatggctgcaagttgaacgcgccggaatggatcattggatcgggcggactgtgggtgagtacaatcgtcagatgcagaagtttgctcgtcatgagttcgcgcgaggcgacattcctaaatcgcacatcatgccaccttatggtcgcgaacagcgcgaagcttggaacaagatgaagttcacctttggtaagtacaagggtcgcctgtatcatgagatcaaatctgaggaccctcgatacttcgattggtgcgcgggtaagggttacgtcaaacgtgaacccctgtacgattaaatagacacatggaagcgtgggtgagcggtctataccagcactttgctaaagtgtcgaacccgaaagggttccgtgggttcgaatcccaccgcttccgccaaattagagatgatcatgagctacacacattggcgcgctgagaaagatatcagccagcgaaattatgagtacgaacgtgccaaatggcaggagaaacgtgaccgtgaactacgagacgcccgagaagtatgtactgatcaagatccagaacgacacgtcggaaacacttcacatcctaagcgggtggaacgggagctatctggagggcgctcgttggaggctctctacccagatctcaaccattacccacctcgaggatgattacttccgcgtcgaatgcatcagcggaactgtgtacactttgagccctcacggcgtggggctgacatcatggacaagttcgatcttagaggacttgaaaactaagcacggcttctctgccgtgatcgatgacgaacgcgaaatcttcaactatctcgtggaaagctcggaaggttgcattcacccttccgttcctgtataatgcccgtaagggacatgtgtcccgagcggtaacaaccctaactctcattggagaatgcaatacatgaagcgtattatgatgatggcgagcgcgctgcttgtcgcactcgttctgaccgcatgtggtacccgagtcgaagttccgcccgcgcatcagggcaagatcatgacgaaggatggttataacgacggactgatcggtccttcgaagttccgcctctcgccatgtctcgcgtactgtgacaacctcgttctgctcgacgcatcggacaaggcagtcacggaaacgatgacgatcttcatgccgaaggacaagctcaaccttgaacttgcacttcgcgtgacgctgagcctcaacggtcagcaggtggacaagctgttcactacccttaagcaggacggtgaaatcgacaatcgcacgaagtcgattagctggggacagatttacaatacctacgcacagcaggtcatcctgacggaaacacgtgagtatgtgagtcgatacagcatcgccgaaatttcgagttcgctcgacaaggtgaacagcgacctccgagtcgtgctgggtgaaaagctgaaggcaacgccgttcaatgtccgctacatcggtgtgacgaacgttgaatacccgaagatcattgttgacgcgcaggtcaatgcagcacagcgacgcgaacagatccagggcgaggaagcacagaaggaagtgtcgcgagtccgactcgagcgtgaactggcagaagcacagctccagcgccagatcgaagtagagaaggctgagaccgaagctgtcgcacagcgcacgattgccgcatcgattgatccgcgagttctggaactgcgtcgcatccagctcggcgagttgcaggtgcaggcttggaaggaaggtggttcgaaggttcctacgacgctgatcacgggtcagtcgggtagccagggtcacaacttcctcttcaatgtcagcggcatggaaacgaagtaagtaactagaagatgggcggctgttacggcagtcgcccccttcattaaagggtagatacgacatgattcttttgctcaacttcgcttacatcatcattacgctcttcgcgattgccggtgcgatcattttccggaagtcgaagaagaagctcctcactatcggtatcgtttgggcactcttgatggctgttctggtcgtcgcaaccccggtgattccgaagtcagctccgccgaagtttgatccggtcatttttgagcctgctcccgaatcggtccagattcgtgacagcctccgaaagccggagtttacgccggaagagcagcgtcaacgggcacctgagttgttcgattggaagacacgtgtaccatcacagaatgtcaacaaaccgaacgatgacctgaaacaggtggatgcagaaaagggcgagtaaccgtaagtaatagtacacccattcaggagtagtactatggtttcgggattggccctagtcgcagcagttttgttcttgatcgcaggcatcttgtatgtcgtaaacaagaacgtcgcaatggctctcattgcgtttggtctgacggcactttcagtagcattcggtgtctaagttagttatcaatcacaacacaaaggagtttcacatgtacaagtcgattcttgcagttgctctcgttgctatcctcgccgcatgtacgccggatcgcgatgaccgcacaatcggtcagactgaaaccgagcaggtccagacggtttcggaaacagagcgtacctatgaaacacaggacgaagtgaccggcgaagtgctcgaggttgagcagaccgaagtcatcaagtcggttgacgaggttccggtgaatgaaacgcacccggacgccgcagaagtcaagcagcctcagtaagtagtttcaaggaagccggggttgaacgccccggctttttcctttacaatatcagtgtctcactgactttggaaaatacatcatgaatcctatgcagaagttcacggcgttagatgacggtttcggtttcaccaggggtcgcagttattacactgccgacgtcttgaagttggaaagcggcgcttacagttgtaagatttcggatgatcgcgcaacgcgacaccagatcaatacagatgttccggcgatcaccaccaacgggaagcgaatcgacttcatggtagccgaggtgtcgagtggcaacgtccagtaacacaatcccggatgagttggtcgctgttccctcgtaccccggctatttctacaatccggtagagaaacagctctatagcttgaaagtgactggcaccttgaagcctctcacatttcaacgcggctggaacacggggcatcgataccttccgcccggtttcaacgtttcagtgaagggtcgcaaacgtcgattcagcatcgccgacctcgactccattcctcgtcatgattactctgtgccctatgaatatactcgaaagctactatgaaatctgtaccaacattttcatgctgggatttctcatctgcgaatttttcgtggatgttggctgtgactacggcgggcttctgttcttcgtcaccttcctcggtttcctcttcataggtctgccgtcagttcctctgttcgcgttctttggcggtctcgggttcatcgccggcttgccgttggtgattgtcgaggtttcgaaattcatgctgatggggagtgattactgatgaacacgcgcacatcgatccctcatggtgaggatcagatcatgatactgctaacgattccgtcatcgaactactatcaaattctgatcacagacctcgatcaccgtcctttaaaatggtgggatagcgacggcaatcacgaagagttccgatacgaaatcgttggctacaataagaagggcgagccggaatggcagtccgtagtgatcaattcgaacatcaaactagtgttgaacgaagagaagttcaacggtgatcatgccgcgtacgaacgcgcattggagaaactgaagtgttgaagaaaggcgttgcatcggacctccacttggacttcggtgacatcaatcccgaattcctcgagtggcgtggcgacgtactgttccttgccggtgacattgctgaggatgatcgttcgcggtctgaaagcctccgtcctttctgggatggcgtcgtgcagatggcaccggaaatctacatggtgtgcggcaatcatgagcactacgggtccgagttagatgcgacgcatgatcacctgagcgaattcttcgcgcgcaactatccgtcgatcatgctgcttgagaatgatacggcgacactgcgcgatggtacgaaggtatttggttcgacgtactggactgacttcggtggtaatccgatggcagaacttgaggtgtccggtgcgctgaatgactatcgtcaggtgcgagtgaagcgagctggctatcgccgcatgaattcgaacgatgtcaagatggcgaattaccgggcgaagaatgctctgttagctgctctcgaagcgcacgacaacttgatcgtgatgacgcatcatgcaccatcgtggcagagcatcgctgaaaggcacaacacgcccgagaactacatgctcaatcatgggtatgcgaatcgtctggatggcttgatcgaagagcacccgaacatcaaaacgtggttgcacggacacacgcatcaccacagccactatcgcatcggcagtacagatgtgatcgcaaatcctcgcggatacccgcgtgagaccgtcgagtggtacacgaaaacctatctgccgtttgaattctgaggtcatcacaatggaaaagtttaagaaagtagtcgttgaagtgctgcatgaaatcgagatgcgcttctacaatatgtttgtctacgcaggtgatgacgacttccgtaagcgcatggctgacgtgggctggactggtaagcccgacaaggagtaagtgatgggtggtaatgcattcgaaaacacggaacgtgtgcctagtatcctggtgaaggagttcaatcaagagctcctcaaccgaggcttccacgccgtcgttccgcgttgggtcgatgaaaagaaagaccatggtgacatcgatgtcctggtcgtcggtcatgatgaggcgcagaagatcatcgaatgggcggaaccttctcaggtgatcaagcacccgcaagggtacaacttgctgatgtcgtggtttggtcgccaagttcaagtcgatctcacaatcacgaactgggaagagctggcattcgctaagtggtacttcgcctacaacgacctcggaaacctcatcgggcggatcgcgcatcgccaaggtttgaagtttggtcatgacggtctgtggtacgtctaccgtgacggcgaccgcgtgttggatgagatcttactcactgctaacgtcagggaagctctggatcatctcggatggaccgaggaagacatcatcatgtactcgaagggcttctctaccttcgttgagatgttcgaatgggtgaagcgttcgcgttacttcgaagagagcgcgtatccgctagagcatcgcaaccacaaggcacgaacccgagataggaagcgcaaggtctataatcagttccttgagtacctcaacatccagagcgagtacattcctgcgaacaagatgagctggctatggcgtcattgggaagcgtttccgcatctcaagactagaatggaagccgcacatgagaaaatgctgatcaagaaggagtggcgtttgcgcttcggtggtgatcgcatcatgaagtggaccgggcttgaaggcaaggaactcggtgaagtgtgcaacatggtccgcgatgcaatcccgattccggaaaagatggaagacatgccggaatacgacaaattactggaatttttgaatgagaaacatttggttcgcgggtgacacacactttggtcacgacaacctccgcaaacactatcctgcgcgcgccgcgtttgcttccgtgcaggagcaagacgagtggatgatccacgattggaacagcaaagtccagccgcgtgatgatgtctacttcgtcggcgacttcggctgttacgatcaagaccatgagtgccgcgtcatcaagcgcctgcacgggcgtattcactacgtcccggggaatcatgatcggaagttgatcaagcgtcccgagttccagcagcgtgtatcgacactgtttcctttctcgtacggcgaagtgaagatcgatggaacttacatcgtactttcgcactttccgatctgggaatgggagcggatgcactacggctcttggcacatccatggtcacgttcacgcgacgccgacaaatatcccgggaaaaattttcgacgcaggtgttgacggcaacaatctttccgtgtataatttcgaggaagttcgcgagttcatgaattctcgcgatgtccgcaaacatcatccaaaaggttgacaaatgatcgtccggtactttcgaaagctcaaatgtgcggtcagccgcattttctctcaggattactacaacgttgacgtttacctagaaggtggtgctgtcatgcctcttcggaatctcaagactttcactatcaagcgtggcgagtctatttcgtgggaacacacggacgcctcacaccgtttgatcactatcgacatcgacaaaatcatcgcagtggtgcaaaaatgattactctttccggtccgcagctcgccctcgtttccgccgccgtcgcacgtgtgaactcgagcgaacatgttcgctgggattacgcatcgaaggagtctctcggcatcgaagagattcgtgtcgaaatcggcgcggagactttcagtgtctacgacatcaagaagttccgtcacgttcggttcgacttccctgaaggctctctggagatcgcagtgcgcgaaactccgaagccgcaggtggatgaaaagccggaagatgatggtccgccgcctggtcagtcccccgcattcgttgaacccgtgaggctcgcagcatgaaaaagattctctttctcgctctcatcgcagtcgcgttgtcggcatgttccaatagcaacgatgcacaccgcgccttgaccggcgcgggttacactgacatcgaaacgcacggatggtcgccgttcgcgtgcggtgaagatgacttcttcaagacgaagttcaccgctaccaaccccgcaggacagcggaccgatggtaccgtctgttcgggtctcctcttcaagaatgcaactatcaggttctgacatgttcaaccttcgcgcatttcaagatatctcgcctgtgttcctcatgtgtgcactcgatctgtatcgtctcgccgatgaaaacatgatcgagacgcagcgatgggatcgtgtcgtcaatcagctgcgctgggagtgcaactgtcaggcagaagtcgttgatgacgtgatcgaattccgtttgccggagacgacgctcgtcctgcgtctgccgggtgagacgaatccggtcagtgcacgcagcgcgccgaacttcaatccgcctcgccacggaatcgcgcagccggagttggtacattgacaccggcacagttcccgcgcattcaatgcttcatcttctacacgatgatggcttggcgcagtgtattcgttcctaaggacggactcgaacttttcgagtgtgcatttgaagggcacgaagagcgcaagcagaaagaattcaaagaaagattcaccaatcaaaccaggagtactaagtgagcaagaccaagcagaaagagggcgtcaagacgtacattggcaagcgcgtgagtgatcgtgagtttaagcgcatgctgggcaccgcaaagactccagcggaacgcgccgcgatcaagcgttttgttcttggtgcggacgtgcagtacttcccgaaggaagagaaggctgccgcgactgcctcggatcagatcgaatcggcgatcaagggcaagaaagcccagtaatcccgcaaggttgacaatccaacctcggtcctgtatcatgtttgcaagtgataaggaccgaggttttactatgaagaagtcgaacatcgcattgctcgttgctgggtttttcatcggcttcaccatcatgggatacatcggcaaactcgatgtcaccacggaagagcgcgacgcgcagacctactgcgaaaacgtgcgcgacggagtgtggcctcacttcaaggacggcaacttcaccgacgtgtgcccgggttacgtgcagggcacctacaaggagtaatccgtgcagggactgctgacttatcttgattgggtgaacaagcccagtcacttcgaagagcgatccgtcgcttatcgtaatgtcggtcatgcggaagcattgatcgaacgaatcaaactcgagcgtggcgcgaatgtccgcgacttcaagctcaatccatttcctgaagaggtagactacacatgcacgcagtgatcactgtcggcgtttcggcgtccggaaagacaacttgggcgaaggagcaggttcgaaagggctactacatcgtgtcgcgcgacgactatcgctggtcgatcatgcgtgataagaacatcgaaccggcatgggcgaagtggaagtggaagtgggaagacgaggtcacggaacgcgtggatgcagaactgcagtggtgcgcgcagatgggcaagaatgtcgtcgtcgccgacaccaacctgtctccgaagactctgactgcgatgcaggaaaagctcgccggactcggttacactgtcgaactcaagttctttgaggtgtcgtgggacgaggcgaacaagcgcgatgccgcacgcaaggacggtgtcggttacgcagtgctggcgaagcagttcgaacagttcaatcttctctacggtgagggtcgagtcgagccgcgccctgacctgccgaaggcgatcctggtcgacatcgacggcacggttgctttgatgaacggcaatcgtggtccgttcgagtggcaccgcgtcggcgaagatgaattccacgaagttgtcatgctcgcagtgctgggtctgtacgccgcaggttacaaggtgatcttcctgtcgggtcgcgactcgatctgtcgcggtgagacgtgcgagtggctcgggcgcagtcctctgaacaccatcgaaggatgggagatcttcatgcgtgcggagaaggatcagcgcaaggacactatcgtgaagcgcgagctgttcgatgcacacgtgcgcgacaagtacgatgtccacgcagtgttcgatgatcgtccgagtgttgcgcgcatgtggcgtgacctggggctgaacgtcatccaaatcggcaatccctacaaggaattctgatatgtgctcaggtcacggtgcgaacactactgaaagtgtcggagggatgtttcttacgtggatcgtggtcgttgttctggctattacgatcctgtactcattcaattcggcagtgaaggttaagcagtacgagcagatgatcaccgattgtgaaacggcggcgcagtctccttgtgagattgtcgccgtcccttccgaggatttgcgatgagtattcaattcaacggcgcaaccggcgaggacttgttcttgctggaagaattcgttaagaacatcttcactgaccgggatcggattctcgagtacgcggaagcgttgtgggatctttcacgtatacgcgcttgggaagaagcagcggcagcggttccgcagatgattgaagacgaaatcctgcgccgtgacatcgaacgtacgaccatgatcactattgaggcgattccgattgaacgctaaacaacagactattgcatacacccggcgcaagtatgccgatactctcaacgcgataaatgagttgtacgacctcgtactgcccacggttcccggcgatgttgcattgaagctggaagaactgcggcatgaggcgtgcgcaaacatcgctgaaatcgagtacgatcacatgacgctgctcaagaacgccgactaaggaccctatgcctatctatgaattccagtgccccaagtgcagcacaaaaattgaaaaactccaaaagatgagtgatccggatgctgactgtccttcgtgtgacagcaccatgaccaaactcatctccgcagctaatcacgtgttgaacggcactggttggtacaaaaccgactttcgaggtaagtgagtatgagacagtacggcgtggtgactgcatcgaacaacaagattgacgatgcactgtttgatcttgctgattccgtcactaagattctgaaccaggagaagagtgaacttgtcggcggcgtcgcgactatctttcttcccaatggaaaatttcaagtaagtcaggcgtttacagtcgaggttgacatcgacttctaaccgtgatataatttctgcattgcagtctattgcataactttgaaaggtaaacattatggcacatgagattacacgtcgcgcagacggcaaggacgaaatggcattcacgggttcgcgtgatgcaatttggcatggactgggacagaaccttgaggacaacgcaagcctcgaggattggcgcactgcagcgggtatggattgggaagttctccagtcgccgctgacctatacctcggtgaatggcacgaacacggaaaatcacatcttccctgatcgtcaagtgctgttccgttcggacaacaaggatccgctgggtatcgtgtcggaagacttcaagatcgtccagccgcagcaggtcatcgaattcttccgcgatctcgtggagaatcatgggtatcagctctcgactgcaggtacgttgttcggcggcaagcgtttttgggcgctcgcggacgtgcagaagaccggcgaagtcacgaagggcgaccgcatcgacggacacctcctgctcacgacggcagttgacggcacgatgtctacgcaggcacgcttcacctcgacgcgcgtggtgtgtaacaacaccttgacggttgctctcgcaggtgcatcgactcgcccggtgattcgtgtcacgcataagcgcgatttcgacgccgatgcagtcaagatcgacatgaagttgattgatgaaggctggacgaagttcatgaaccagatgaagcacctcgcgaacaagccgatgtcggcacgtcagacgcgggagttcttcgaagagcagttgttcgacccggatcgtctcgcacatgagcagacgtggggtgtcacgcgcgaagttacgcgtctgaccgatctggctctcggtggctcgggttccgacatgtcgcgcggcactgcatacggcgcactgtgtgcgatcacggaacactacacgcatggcaccggtaagcgtgatccgtcgcgacagttctgggattcgtatgtcggtaatggcgaatcgaagaagcagagcatgttcggcagtctcatgcgagaatacgcatgaggctctggaacacctacaaaacgcggcgtttgaacaacccgcgttggtggctcactcttcctctggtgctgaccatcatggcagtcaccttggtagccctcccgtttctgttcttgctcgacatgatcgtcctgtctatcgtctttgttcaagacgtattcgtgacgttcggaaagtggttgtctgacgacatcgcgcctcgactctctaagtgggtttatgaaaatcaccctgcaagtagcactgactaagattgccgaagcatatggtctggataagggttgtctcatcgacaaccctatctatgaccttctcgagcgcgagcgcggcatcggatactatgatgacgcgagcaaaatcctcacgaaaaagaacgtggtggacaatggcgaaaacttcgtctatgacttcaagtcgggcgtcgtggtcacaaacctcttcaccttgcactcggtgatgatgcaggcgatctacttcgaagtgaaggtcaacactatcgaaggtgaactgactgatatccagaagatcggactgcgccgtgatcatgccgactcgtacatcgaagagggcatgggtgcgtttcgttcgggcgtcggtcgatacatcatcgttggtgaggacgtggcactgcctcaagagctgcgcgcgccgtatttcaagaacatgatcaagcgcctctaattattgcggagaatttatgttttcctttgaaagccgcgatgccgcgtttgcagaaggcatcaagcgttttatcgtcgcgcacaacctgaccaacctgcagtatgaagatgcgatggtgaacaagggcggttatcatgccgcgatcaatgcgtttcacgcgaagagcgatttcctgacataccaagaaacggttgcgtggaatcaggatggagtgattccgaagttcatgaccaacacgtttgcacgcatcgaagccgccgcatatggtgctccgatcatcaccaagcacatcgtggtgacaccatgaggtacatgtaccacaaggacggatcgaagccgcaggttcaccaaatcttcgtgttcggttcgaacctcgcaggtcgtcacggaaagggcgcggcaaaggctgcacatgaaaagtacggcgcgaagtatggcattgcgtctggcacgactgggcagtcttacgcgattccgactaaggatcagtacctgcacactctggaactgtatcagattgagcctcacattgaatcgttcctcatgtatgcttcgcgcaattcgaatatcggatttttcatgacgcgaattggatgcggtcttgcaggctacaaagattcggacatcgcgcctatgtttcgtggtgctccgtctaatatcaacttccctatcgaatggaaggaatatctagaatgacgatttaccaacgactgcaggaagcgcagttcatgaccgctgaggtcgagcgccagtacctcaacgcgattgaaaagttcaaatactacaatgagatcgaacgcccggaactgcaagagcagatcgcgcgtatcggatttttgattgagtccagccgcgccgatgtcgattgccctcagttcatcattgaagagctaatcgaatgcatccgcttcaccaaccgtcagcgccacaccaatcgcaacgagatcaaatactgggcgcacgtgtgcactcacctcaagcgtgctcgtaagcaagcacaggtggagtactcgaccatccgcaaactgatcgcacaaacgcaacatgaagactgaatctcggcgcgtgactgatcgcgagtttatggatcagatcgcgcacatggataagagattctattactcggatcatcatctcaagcgcgatttcactgcgactgatccgtgggatcagttgaagcgcatcgatgatattcgaacccttctcgcaaacgatcagatagatatcacgcagccacgatggtatgatcgacctgaaagagctgcgtggcatatcaagagacgcgacgaaatccgaaacgaactcacactcatgtctgaaatactaacgaggaattccaatgcagggaacacttacacttggtgattggtcgcgagacggtcacaatcaaaccgacactatctccgttgaaatcactggagacgttgcagccctgaccggcgaaggctgcccagctgaaatcgatcagtacaagggcggaaatcaagggcgcgataagacgtggggctgtgcgcagactcccgatctgtgggcttacttccgcaagggcgttgaagttctcggcgtgaacatcacgaagcgatgcagcgactatgaggatagtttcattccgccaaacgaagtcattgcgatcctcccggatgcggcagaagattttggcgatgacttcgatgaagatgatggtgtagacgatgcaaatgagtactacatcgattgctggatcgaaacagtcaacgcgggcatcaaggcttcgaacatcgacgcaaaagtaaaacgtctcttcggtaacgccgcgccgaactggaacattggcggctacggactgttctggaactgacatgggcaatctaacagttggtgacatcagaaagctgattgaaaacgtccccgatgacactcccgttctgacggctgggttcgatcacgaatacaatcagtgttggcagagcggaagcggttacggattcgcattgcacgacaaagattcaaatgtttttagtgaggacatctacattccattttctttctttgatgacttggattaccaaggcgagacgcctgataatgacggcacaggagagcttacggatttgggagtccgcattcgcgcgctcttcgtgcagtaaatacgaaaaactacaaaaggaaacacatgacgatcagtgcaaaaatcattgcggatagcatcacgcaacacggaaagcgaatcacgacttatgagttggaatatcagcgtttcgtccactcggagttcatgactcaccgacttttctctcgcaatgctgcatcgtcgcgtgctatcccggtagagaaggcgattcgcctcatcctcgagaacacggcacgccccatgcattggggcaagaatcagccaggtatgtcggcgaaggaagagtgcttcgccgatgtttacatctcagatgagatcaaaacgcgtgaggaagcatgggaccatgcacgcgattgcgtggtcgaaattgcgcaggcgttcagtgcagctgggtatcacaagcagatcgtgaatcgtctccttgagccgttcactcacatcaaggtggtgttgacgacgacggaagacgtcaactggaactggctgcgcaatcacacagatgcacagccggaaatccacgaactcgcacgtcagatgatccttgcgaaggctgacagcacgccggttcaactgatgcctggcgactggcatactccgtactaccagaacggatactggcgtgattcggggtacggaaagtttgatgcggagaacaaaaagtgggaggcatctgaccggaagctgggtggtcacacactcgcggaagccctctctatctcttcgtcgtgctgcgcacaagtctcctatcgcgtgttgaatgactcgctagagaaggcggaagacatctaccagaagctcgtcggcagtgagccggttcacgcgtcgccgttcgaacatcaagcaacgccgatgaaggatcctgacgccgacaaagctgcacgattcgagtgggaagagggtatcacgcatgtggatcgtcgtcgccgttactggtcgggcaacttcatgggatggattcagcaccgtcagttgatccctaacaacgtcaagtgggatgactaactatgctgttcgaagtgatcaactcatttcgagacgaacacggatacctctctaacttctggatggcaccagtcgaattaccaaacagtgagaagtatccgtcgtccgaacacgcataccaggcacaaaagagcatcgatcccgtagtgcgtttgcgcattgcatcattcaagtctcctggtcaagcaaagcgcgagggcggtgtcatcgacattcgcccggactggaatcaggttcgagtgcaggtgatgtttcacattgtcctgctaaagttcgaacagaacccggacctcgcagagaaactgatcgcaaccggcgacatccttcttgaggaaggcaatcactggaacgacaagttttggggcaccgtcgagggcaaaggtcgaaatgttctcggaaacatcttgatgagcgttcgctcaatccttcgtgatcgcaagaaggttgaggaactaaatcaaaagatcactgcctattgggttggtgatccgatgatggacacaccgatcagtgatcgcgacgtggatcgaatcaatcgcatgatcagtcagcgagacgctcttgcaaacaagatcgatcaagcgttggcgatgcatgggtcttctgacatactaacgtattacacataatacacactgtgagatatgtatgacacaaacgacatcggaaaagatcaacgcgaagctggatgaagtttcggagttgagtagaaccctggacgatcatcactataacactgatgagtaccgcgagaaggaagagcgcatcgaacaattgcgcgaagagatctacaaaatttcgcgcgagttcaagaacagcgacgtgatcaagacattggagcgcatgagtgatgagtacatcagtccggaaggtgcgcttgatcgctgggtccatagctggtgctaagtagaacagttcaacaatagaggttcaaatggctagattcgtttcaacaaaagagtacttggagattggtcccgttgcgtatcgtcaatggcgtgaccaaggcaactgccgtttgattcacggttacgcgttgtcgttctatttcgaattcgagtcggacagtctcgatttccgcaactgggttgtcgattacggcgggcttcgtccgttgaaggagttcctggaacaattcttcgatcacaaatacctgctcgcgtctgacgatccgaactatgacgacatcaagcgtctggagtctctgggtctgttggagatcactgaggtcgaggcgacaggttgtgaggcgattgctgacttcgtctataagtacttgaattctgggttcttgaaagagatggggttcagcgacgtatggtgttcaaaagttcaagtgcgcgagacacacaagaacatggcgatgcgcattggtcatcgcaatgacgaagaagacctcttcgcaccgactgccgaatatcggcgttaatgacagggggcttgcctgtccggaacaaatcagacaatgcagagagtttgcaacggctgaattcctcaggcaatccaacttcgtccgtgaacgcttcggcatcacggactatgatccagcattcagttgtaccttcgcaccacgccattgcaccagctatggtggcacgctgatcgatgactcgccattcgttcacttgtcactggcgcatattgcgtatgcggtaggctcaactacagaatactgctatgaagaatacccgcacatcgatgctgatccagtcatcggcgcagggcgcggaacatggaaagcaaacattgcgtggttgatcgcgcatgaggttgcgcatacattgatcgaaatgccttcctatcgagacaagatcaaggtcatgttcgatgcggaggtcacaagggacattagcagtcacggcaagtattggcaggcagtgtatcgtgtgatccgtggtgagtgctgtgatgcattgcgcgacgagttcaaggcaacgcatcaagacttttcggaagtgctgtatcactcgacggtcaagaaagataaggtgtcgtatatcgtgatccatcgcggtatggagaacatcgcgtactacctccgtgaagccggtatcttgtacaaaagtaccaagactttcaaaggtcgccggaagtgcaagttcaaaaacgttgcagaaatcaaggctttcttgcgaggttgacaacataggaagtgtatgtcacaatgctcatcacagtcaaacgtgatgagcattttcactatgatcacctcgcagaaagaagcgcgtaagctcttcaatgccgaaatcaagccgatggtgcttgaaacctatgcggcgtccgacaccattgcgctcaatgaggcgttcaacgattgggtggacagtatggtcacggatcgtgagatgcccgagcgcgcgctgaactggacgcgaaactgacatgggatctgcacgtagaagtcagaagactcgcttggtgaaagagcacggcaagttctgtttctactgccgaactccggtaacgcccgaaacggtaacgcgcgatcatgtgcttccgaaatctctcgggtacacgctgcagacgaactgtgtccctgcgtgcggtgagtgcaatgtcggaaagggcgatcagttgccttgtcgtgacatcattatccgattcatcgacagcctgcgcaaacgcggtcaccactatcagaacctgccgcgcttctatctcggtttcatgcgcgaccagcagctgatcgacgtgattcaatactgcttcggtgaacccaacatccccggtctcattcgatcaaactgagaacacacatggaactcaagtgcggaaacgtctacgcggcaaagaagcccggcaagatcagctttgggctgtttgaaaagccgctgatcaatgatcgcgttatcgtctggatttctcccgatggttcgcgcgtgcagtacgatggtccggcgatcaagatcggacagaagcgcccgaccgtcagccgcgacgctttcctcaagtgggctggctccgacgtgaccgacatcatgccggaagagagttggcgttatgcgtaactatcgcatcatctacaaaggcggcgtgtatcgtccgcaagtcaaacggtggggcttctggagaaacttctataacgtctcgtgggattacgacttccttgatagtccgcaaaggaccaagtcactggtgaaattctgggacaaatccaccgccgttgtatacatcaaagatattgaagaccagatcaagcgcgacgaagaaaagaacaagcccgcagaggtggtgtggtatgccgactacggcgaacctggtatcttctcacgcattgccggattcttctggtggcatttttaacaaggaatcatgatgacacgtaaactcgcaacaattcgcaagatcaatgaactgaacccgattccgggtgctgacgcaatcgaagtcgcaaccgtcgatggctggaaggtcgtcgtcaagaagggcgactacgaagtcggtcaggatgtcgtgtacttcgaaatcgacagcatcctcccggcaggcgttccggaattcgaattcctgatggctcgcagccgcaaggagtatcacaccgatgagggcacttacctcgacggtcatcgcctgcgcacgatcaagctgcgcggtcaggtcagccaaggtctggtgattccggttccggaagagctgcgcatcgaactcaatcgggcacaaatcgaaatcgaagacgatgagtcggatttcatcaccgcatggttcggcgtcaagaagtacgagatgaagatcagcgcgcaactggcaggtctcgctcgcggctcgtatccgcattggatgccgaagactgaccaggagcgcatccagaactgctaccgtgatgtcgaggaatcgcttgacgaactgtgggcgattgaggagaaggtcgaaggcagttcgatgactgtctacatcacgccggaaggtgttggtgtgacgagccgcaacctcgacctcaagctggatcaggaaggcaacgcattcgttgacactgcacgccgcagtggtctgttcgatgctctcattgcattccaggagatcagcggctatcagtacgtcgccgtgcgcggtgaactggtgggtccggcgattcagggcaacatctaccagctgaccgattaccgttactacatctacgacgtgtacattcccgaaaatggtgcatacgatccgaagggttacctcaacccgattgagcgtgatcactttgtcgaaggtgtggtgcgcggtcatcctctgatcgatcacaacatcgtccacgcagttccgacgattgagattcacaagctgtggaacatgagtgtggacgatctggtgacgatggctgacggtaagagcgtcataaacgaaaacaccaaccgcgaagggctggtgttcaagcgatactctgacggaaatgactcgttcaaggctatctcgaacttgtatctcctgaaggagaagtgatcacggaagacgtgatgcgtcaccttgcccggtaatctcttgggcaagactactgatctgatctgcgccccaggcggtttcgtcaatgaacgattccacacctggggcgcttttcattgctgcaaggcgcttgaccaggatgttgagcatacgcagttgtgacttgatttgagtgttctccgacgtaagctgtcggatagtccctacagccgactcattctcttccgcaatggcaatgagttcctttttcaagtcggcagcctccgtcaacgcatcgttgcgttgcttgatgaggtgttcaatcaagttttcctcggcacgatcctttgcgatctcgagtttgtcgcgcgaccaacgacgcgccatgataccaacagccacgatgataccggcaatacctgtgcctactgcgggtagtattccttcgatcatgtgattagcctgattagtgtgcgtctaatcggtcccatattccttttctcatgccacgtcttatgagattcgagatcgccgtcagggaatgcacgtgcgatagttgactggagcttttcctgtagttcagaaagagtcctctcacatgactgcagacgctcatcctgagccgcgctgttgttatgcaactcggtcacgatatggagaatctgagtcagcaattgctcagtgctgttgttctgagccgatggtagttttggaagggactgattcatttgatagggtgaggtgtattcttttttatttatcgctctcgcataaataagaagtacaatgctcatcacatcacattaaggtagctaaccgtggcagaaaactttgacgacatccgaatgaggtctccattctcatctgtggacggaactgaaaccctgatcatcaatcaaggcggaacaaccaaaggcggcttcctcagcgtgttggctaacttcatccgcgacaccattcaagtgaccccatcgaacatcggcgcaccggcgacgacatatggtcgtggtctccttgaaacggctgaccgcacagcacttcgaacagaagccgcgccgatccttgcaacggaaacggaactggggacaggcacaaccactcagattcgctcattcaccccggcactccttgcgccgatgatcgcaacacacgcacaaaaaacgccgcaagcaatcacacaaacgactacgctaactgccgcacacctagggaaaatactggtgtgtgatgcatcaagcgcgattgctctcacaatgcctactatcgcttcacttgcgcgtggcgcattgcagatcatcaacctcgggtcgaacaacgtgacattgactgcgggtgcaggcatcacctttagtggtagtaccggcacaatcgcaaacaaagtgattccgcagtacgggcgcgttgaagctctgtacctcggatcgaacagatgggacatccgagaagtatgaagattgtactgccgacagttattgacgatttcgatggtcagtgcgctgcacttgacaacgcgatcttgactgcggctggtcagttcaatttcgcctacgaacatgacgcgccgcgctttgaagctattcagcacatccccgaactcatctatgagctgatccgccactacacgttgcgcgggttcaactgcacatacgatggtgacatcggaaagctgcgcattgcatgggatcatccgaatatgtcatggatcgagcgcaagaacatcacgcgttcggtgcctgaaatgatcgaacacctcggcattggcttccgcgcgtcgatggtgtacctatgcatgacgaatggtgaagaccttcgcggacactccgacgttacactcatgcgcgagttggacaagtcgatcaagaaggctgcgacgttgggtaacacagaactcgcgttcggtttccctgcagttcccgcacctgtggtcgagaatttgttcagcaaaacatttgactatctcgctgcacatgatttcatcgtcctgttcaacgcgaataccaacttgtatctcattcgctggggaaacactttcaaatttgaggcagctgacggcaatcgtgcagacctgctaggagtataagatgggtcttgtcatcggcaaacctcgcgggtgtagtgatccgctgatcattcgttaccgcaaggatcagtcggtcgctgattacatcccactcaatccgaatccagacgcacctcacccggtcattccgatcacgggtgcaggtgacatgttccgtgccgtgtacgatcaagacgcgaatggcgtggtggatacagttgatcgcgtcacgattcaaaaggtagatggtctacaggacatcatcaatgatctctataaccagggcggtggagaaggtggtaaggaagttgtcacagttacgaacaacggaccagacatcttcatgcctggtacacctgtcgccaagttcggtgagatgtacattgccggtagttctatcgctcctggtcatcgcgttattggtctttcaacaggggtttcagctcctggcgacaccattcggattcaaaccgcaggtctgatcatcctcccagcgacatcatgggatgaagtgacgggcgacgttggtggcttgggtcacggacacttgtattacgcggacaaggacagaaagctgtcgatcatcccgcctgcgggagagccggaatacttagtaaaaatcggcatcgcgttaaatactactgactttcttattgacctcgacttcgcggtcaaactctaatttggagaatgccagatggcagattttgcacctattaaactacacgacagtgaactacagcgcttccaagctggtgacactgtcggtattcagcacggtggtacaggtgcagcgacagcggttgcggcacgcacagcccttggcttggcgattggcgttgacgttcaagcgcacagtgccacactcgcaggcttgtccaactggtcatcgcctggtatcctcgtatcagacggcacgggtggttgggttgcacgtcaaatcgcgtccgcatcgaacgcacgaatcactgtaagcaatccgactggtgtagctggtaacgttacactcgacctcgcaactgtcggcaacgcaacggcgagcggcttctacaagatcgcgtatgacgcatacggtcgtgtcacaggcagcacaccagttacagtaggcgacatctccggtctcgttgacccgcgctacgtctatgtaagcggcgacacgatgacaggaccgctcacacttagcggtgatcctactaactcgttgcacgcggcaagcaagcagtacgtcgatgccgtgatggcgtcgggtggtatcgctccattcccagaagcacgcgtcaagacaacaggaaacatcacactcagcggtttgcagaccgtcgatggtgttgcactcgtcgcaggtaaccgcgtattggtcgcgagccagacaactgcatcgcagaacggtatctataccgtcgcatctggtgcgtggacacgagcagttgacgctaacgagccatccgagttcgctccagcgcgtacagtcttcatccaggaaggtaacctcaactcgcgtacatcgtgggcggtttcgagcgcagctaaccctgtcatcggcacaacgccaatcacattcgttcagacctcgggtgccaaccagtacacagctggtaacggcttgcaactcgacggtaatcagttctcggctgtcgcgatcagtggtcagatcgtcgtcaacggttctggtattggtcttgcaacatcaggcgtcacaccgggtgagtacacgaaggtaactgttgactcattcgggcgtgtgacatcggcaggcgcggcgactgcatctgacatcggcgcgcagcctcagagtgcagcactcacagcacttgctgcgatgtctacatcgggcatcatggtccgtacgggtacgaacacgtacacagcgcgcacactgaccggatcggctcgcgtcacagtcacaaacggcaacggcgcgtcaggcaatccaacgttcgacctatcgacaactggtgttgcggctggtacatacaactcggtcactgttgacacatacggtcgtgtgacagccggtacgactgttgcgatgaatgagttggaggaagccgtcactaacggtgaatccgcagctatcgcaatcggtcgtgtcgtctacatctcaggtgcgaacgcagtccgtctcgccaacgcaaacaacatcacgacagcgaagtcgttcggcatggtcatccagccaacgattgcagctggtgcaacaggtcgcgtcgcaatgacgggtatcgttgaagcgacaacaggtcagtgggacacagcaacagggcagacaggcggcttgactatcggtgcgcagtactatctctccaacactgttgcgggtcgaatgacgacaacagccccagagtctggcgtaaatgcgcctatcggcatcgccttaagtagtacgaagttcaaattagatattcagagggtggtgatcctgtaatatgggcaaactagttcatctagagtccggcgaacatgcagcgtcttcccaggtaagtttgtctggggggacgtttcgctttgagggctcgtcggctaaattcgcattcaagtcgggtcaaacatacgttgacgccgttgaaatttcaccaactcaaatctcgattggctctaacgtctattggcatagtggtacgttcaacccttccaactacatgccgacatcatggagccttacagccggaaacggtttgacgggtggtggtacaggtgctgcgaatcgatcagtcgtgcttggtacgccatcgagcatcacactcacttcgacaaacacagtcggaacggaaacacacacgcacaacttccttcctggtggtacaacagcgcagtacattcgcggcgacggtacactagctacattcccaactatccctgatacgtcgtcgtttgttcagaaggttggcgatacgatgacgggtgagttgttcttagctccgtcgactgcatcacgcccaccagtcaatcttggtcacggcgtcgcagttacgaacctgactaacggcgacctgtggatgacctcggctggtctgttcggacgagtcaacggtgtcacgcaacaatacgtccctacaacaggcagtgtacctacactcacaaacgcgcgcacaattgcgatctcaggcatcgcaactggtacagcaacatcgttcaatgggtctgcaaacatcacaattccgatcacggcattgaatcttgcggcatcaggtgtcactggtcagttgccagttgcacgtatgggtacaggtacagcaagcagcagtacgtatctgcgaggtgatggaacatgggctgcagtgaccgcatcatcgatcccatgggcgaacgtaacaaacaaggatgaagtctgggtcaataacatgaccggcatccgtgatttcgctaacgggtcaattcgtgctcgcggcaataacgcacgcatcatggtgttcgatgatctgctcgatattcctgatgtcgagctgggtgctggttggaataacggcaccgatggtgttggctatatggtcaatcgtcgaccattgttcccacttcgacttgctggtcgtaatgccagcatgtatctgggcttgggtgagggggatcgtatgtcgatcctccacaactcggcgctgcagctgacgagcaatcccttcatcgccaacgccacctacggcgtgcagaacgtcgcgctgtcgatgcggtggaacggcgcacccatctggcaggcgggaactgagaacaacggcgacttccagatttgggcctacactgatctaggtgcatatcttggtgtgcggctgcagatgaagggtgatggtcgtgttgcctttggtggtgccacgattggctcggatcattattctgcccttactactttcggtggcatcaaatcacgaggctatgcagctgcactcggcttcgatgagcgttccggtgacggcaacgaatggaactggtatgcaaatggcggtactgctcgactctggtattccggatcaggtgatctaatctatgtggatggctctggtcttcgtgcctctgcaggactgaatcaaggtgccaccgatgcaggctggaatcttcgatggaatgcgattgcaccgggcgtcggagcgtcggagtacatcaacaaccgacagggcggaagcggcgggcacattttcgcgacacgtcagaatgagggtcaggtgccgcaacagcaccaccacctactgtcgaacgggcgcatgaatatccgaaccgcaaacggcaattggatccagcagccacgcatcttcagtggcggtggtgatccaggtggtgcagccgatcccggcgatctctggttccaggaagtctgatcatgcctgtgtatggtcttcaacaaggacgacgacgatcgctgattcgcaatgcgcaaggcaccaactggaccgattgcattgtgtggcggcgtaacgctgcaggcactggttggaatcgggtacatagtgggctggtgatacttcagcctactggttccggctactacgctatcagtgtgttggagcccgcacccggcacccgaaacgtgacatatggcggtgcaggcatccaagccatcgaaggctatggtcctttcacctacagctggactcgtatcggtggatctgcacagatgcaggtgaccaacgcacatcttccaaccccgattttcagtgcatcggtcaccaagaacactgaggtcacttcgacatggcgagtcagcgtctacgaccagatgactggtcgaactgtgacgtatgatcgcagcatctctctcggttactacaccaacatctaagggaatcaaaatgtacctattaaaacttgatagtgaaaacaaggtaatcacaaacgaagccacagcaacatcgccatctgttttgactcgtttgtcgaacaatcatgttctatctcatgcagcagttccaattggtcacacgtttgatgatgagactagaacattcgttgcgccacctgcagttcgtcaaatcacacgattggctttccttcagcgcattactatggctgagcacgtcgccattgaacttgcatctatccacaacccaactgcaccacagtctcagcacattgcagcagctacgttgcgcaagatgctccagttggtgaacgcagcaaattggattgatcttgatcgtcctgatacacgtgagatggtgatgcagatcgaacagatgggattgctcgcagctggtcgcgcacttcaaatcctcgacgcggaaatcctaccaatcgaaatgccgcaggcggacacaccaagggcggttgaagcatgagttcagtcaaagtaatctttagtcgccgtcatcacatcggcactatcatccttcgcggattcttgtggtcgaagtggagtcactgtgcgatcattgacggtgatgaagtgatcgaagccgccgcaccaaaaggtgtaggcgttcgccctctcatcgaattgatcgaagagtctagcctatacgaaatcgtggagttcccttgtgagaatccggaagcggtgatcgccgcagcccgatctaacatcggcgctccttacgattggggtggagtggttggtattggattccgtcgtcgttggcaagatgatgacgcattcttctgcagtgagcttattgcagctgcattcactgagtcaggtcaaccgatcatgcgcggtgatgcgtatagaatcactccacgcgatctctacctccctatccgccactgctggtcgtgtaaatatccgacagaaaccctaacaatggatcaactatgaataatgaaaacatcatcgctgtaagcgttcatcctcagctctttcaggcaatcggcaactacctcgtaacgcgcccatatgccgaagtcgttgaacttatcaaaggcatggagcagagcatccctgtcagacaagaagacaatgaacagccacctgtcacgctaccttcaggtgatgaaacatccgataaataagaggtctacccaatgggaacaacgccagtgagcacagaaacagtcgcaatgaagatgggcgcatcgtccgaaatcgcgcaagccttagagaatgcctgcatcaagtttggcatcatcactgccgttcaaaagtcccacttccttggacagatcagtgttgagtcgggcggcttcaagacattccgtgagtcgctcaactactcagtcgatggactcatgaagaccttcggtcgtcatcgtatctcggcggctgattgccagaagtacggtcgtaaggctggtcagtcggctaaccaggaaggaatcgcaaacgccgtctatggcggtaagtggggcgctgacaatctcggcaacacagaagccggtgatggttggcgtttcattggtcgtggcttgaagcaactcacaggtcgcgagaactacacgaagtactctcaagcaatgtacggtgatgatcgcatcatccgcaacacagcattgcttgaacgtatccctgatgtcgcactgtcagctggttggtattggcagtcacgcggtctcaatcgttttgctgatgcgaacgactatgagacagtaacacgtcgcgttaacggtggtatgaatggttacaatgatcgcgtgacggcaaccaagcgcgcattgcaactattcgaggcacgataacatggcattaaaggaagacatcttcgctatctttgcaggtggcgaatcatggacgaaaggcacaagtgcacgtgacgccgatgggcgtccgtgccctattctcagcccgagggcggtctcgtgggacctcgtcggtgctctcatcaaagcaaaccacgacgcaggcaacacggactatagtcagttgaatgctgcatatgcagacctgcgtactatgatcccttcatcgttcaagagtggcgatgtcgaggcttataatgatgtcgccgaatggagcgacattgacgccttcttcaatccaactgacgaagatcaggacgaagacggctccccttctaactaaagaggagtaaaacattgctcacgcgctgagttggatactattccagctctgatttcacgctgccttgagcaatgttacaatgtacctatgaaaatttacgaactcatcctgtgcacttgcttgtgcgcattgacaacaactgtctattcacctgacaacatgaagcacccggcgtcattcgtcgtcccgcttgttgaggatgtcgaggctgtcgtacctgagcatccagctttggatgatcgtcagttggcctgtctgcagaagaatatctactttgaggccagaggcgaaggtcgtgcgggtatgcgtgctgtcgctaatgcgacgatgaaccgagtgaaggatcctcgtttccctaagaccgtgtgtgatgtcgtgtaccaaccgagtcagttctcttggacgcgatacaacccgcgcgtcaacttgacagcgccaggtaatcgtgctgcatgggagacagccggtgaagttgcggaaaaggcgatcctcggaacccttgcaaacaacgtcggcaacgcacagtactttcatgcgcgacacgtcagcccttcatggtctcgccgttttcaacaggtagcaacggtcaattctcacgtgttctaccaccaacctctgtaactgtctgattctgaaggttgacatgtgctgagattcctgtagtatttcaatcatcgaaacacacaacggaatcgatcatgcgtttcttcttccaaactgagcgaatggctcactggttctttggtctccttgcgagccagggtcgagcggcaacactgcagacaattccgaacggcttcgaactgaaggtgaactgatggatgtcgattcggtcttctggcttggcgtactgctgactttcgtcgcagtgatcgcgaagctctcaggctatctcgttgcagtctcgtggtggctgatcatcgctttcatcccggcactgttcttctttttggtgatcgtcgtcctcgccttcgcagttctgacggcaatcttctcatgaatgacgatattctcttcggtatgttcctcggtgcggtcgcgggtatattcacgctcgtactgatcatcctgctcttgaccaatccgcctttcgtcatcggtgggatcatcggcggcagccttggttacttcatcttcgaagccctccggactccatcgttctacgaaatcgatgagcagtactcccgtcaccgtcgcatctgagatatagaatgaaaaacgtcttcgtcattgtcggtatcattgctacactggttctgttggtgttgcaggttaccggttcggtcagcctttcgcccctcgtcatcctgtcgcctctcctgatcgcgtttattccggtgatcttcggcatcgcggtcttcatcggcgcactcatcctcagcggtatcgtctacctgttcaccgcgatcttctgggttatcatcatgggctttgcgtgtttgcaggcgggttatgcctctgcacgtcgccgcatccgttacgcattcaacaagtgaaggaatctgtcatgctcgcaccgtatcgcaagtacctggagtctctgccctacgaagcgcttctgatcgaagcgaacgaagtgtgggcgatcaatgaccccgagggctacctccgcgaagagctggtcgaagttctagtcggcaaggacgaagaagagcggttccgctgatcttcacgcgcacaaacatccaaattcaatcgagagcacatcatgaatcacaccatccatctccgcgacaatctcgacttcggcaggactttctctctgcgctatcgcacaccggaaactcgtgatgagcttcctcagtgtgactaccaggaagttgacgccgacaacacgttcttctccacgcagtacgtgatcatgcaggttcaggacggcacgtggacgccggaaagcatcgaactgcagccggctggcgggttgaatatcaacatcgttccggaacaggagccggaagtcgaagtgaaggaagaggcgcccctgcgcacgcgtaccttcaatctctatcccgacgcgcccctcggaggcgactacatcgaagttttcactgagcaggcagacggtacctacctgtgtcctgatgacatgacgtgggacctgagtgagatcaacgaagccctggacgaaggtcgctggatcgaaatcttcgatgagcagccgaccgtcagtgacaagccggctgtgcgtcgattccatctgttcccgaacaacgatgcgatctcgcgtgcggcaggtgggaagctgatcgaagatttcatcttgcaggcggacggtacctacctgtgtcctgatgacatgacgtggaccgatcaggatctgcaaaacgaaatcgatctcggtgcattcgttgaactgccggtggaagagtcggtggaagacgatccctacaacctcaacgagttccctacgggtgtcccgatcctctgctgctacggtggctctttcgatcagacgatccagcgattcgaagatggcacgtggggaagcccgaatcagcctgaagggacgtggaccgttgaacgggtgaatgagttcctggaggatggtcgatggtcgaacctccgtgttgcaccgcccgagccggaagagccgcacatgatcgaacgttctttcatgtcggatgagggtaccgtggtcgcaactttccgtcgatggaatcacgagaacacttggacgttcaaggcggtctgggtagatggttcgaatgagccgctgaacttcaaggacatcggcaatcacgttatcgaaatctacgagaagaactggaaggaactgccgcagacgtttgatgcgatgggtcagtgggaagcggatggcactgtcgaagtgaaccgcgtgatcctcgacaagctcaacactgatgcgatggtggttccgagcgaaaacggtgtcgtgtacatcacgcgcgatgaagccaagaagttcttcggattctaagtcatgacgatcacgtccacactcaatgccctgatcactcagggctccgcatccaaggaacagttggagtatctgcgcgatcaaatcgaagcaacgctcgctgatccggctgcatattgggtgcggacagtgggtgaggacaacttcatcgtgcatcagtactttgattgggttgatcatcagccacctggttatgcgcctccggaacatggtagcctcgtcgcagaactggatgaggatggtgaagagaactggttggcggggttgcgttacgatgtcgtgccgctgattatgggtcgcaggaatgaagtgtgatctttgcggctggggctttcatcgcgattgccccgactgcctcaacagattagatgaagagctggagcgtcgtgatcaactcatgatcaccaactatgaagatgatgacgccggtttccctgatgaagaatttcaagagtactactgatatgagcgaagtgcaagtcattatggatcagatcatcgcccacgtttgggatgatgacatcgaaatcctcaagtcgaaaggcagtaccgcactcaagaccgacacgagcgcggacgcaaaggaacgcgctctcctgaaggaaatcgttgacggttgctgggatgaggacttcgacatcctgaaagcacacatcaagcacgagcgccgctgacatgagcaaagaagttatcgaaacactcgaactgctgcagcgactgggcgggctaggtcatcacgtacacgcgcgcattgataagtgcatcgaaatcctgcgcgatgatccagtcaggaagctgcctgaactgtggcacaagcaagccctcgatactcatgagcgtgtggcggaattcaaaacagaggaaggcttcgctggtgtcctcgctcgcacgctcgcctatcaagcatacaccaaacagcagtgcgctgacgaactcgcagccgcactaggagacaagtaatcatgcatcaagtcagttcagccgtcgtcatcgacacactcaagatgtccgtcctccctccgagcatcaccctcctgcctgcaacgttccgtcgtcatactatcgaagagatgattgaggcagcggaagcgaacggcatgaagttcctcctggatacctcgtacaatcacgacctcgggcgttatgtgctgcgactcgaagtgactgcaccgaacgaggaagacctctgtgtcgactaacagccggaaggtcgagtttccgatgatgtcagccgcacactacctcgatacgctgattgtggctgcacgtgacacatgctcatctatcccggttcactacagcgaactggagctgctgcggaagctgatggatcatgagaggaatgcaggaccgtcgtccgaggaagttctggctgaaaatgcactcaaggcactactcacagaactggacagcttcaccgatctgctgaactatagcaacatcacagccgaaaagtgggagcagttcgcgggtgaactcaatctgaagtacattcgatacgtcaccgcaaaagcgtttgtcgatggagctgcacatgtcgcttagtacaatcatcctcagcgtctacgatgcacaagggcgacttcgctgctcagtccgtaaaggaaaagcggtcggtatcgctgagatggtatcacgtcagttgggacgccttgagatcgtcggcggcgaagtcgcattgagagtcacggatgataagctcgaaatcgaaggcatcgcatcactcatgtatgcatatgccggtgatctgatcacggagagtcctgatgcgtaatcatcaaggctacggcgaacatcaagacgtctacatgagcgaggatgagcatcaactcagactgctattagcattccgtgtggcgggtatcatcaaaggatatttcagcgacggtgagctgcaagataacagcgaacatccattcattgacttcctacgagaca

What is claimed is:

1. A method of preventing or reducing symptoms or disease associated with *Xylella fastidiosa* in a plant, comprising contacting said plant with particles of at least one virulent bacteriophage, wherein *Xylella fastidiosa* and/or *Xanthomonas axonopodis* are hosts of the bacteriophage, wherein the bacteriophage belongs to the Myoviridae family, and wherein the bacteriophage displays the following characteristics:
    (a) the bacteriophage is capable of lysing said *Xylella fastidiosa* and/or *Xanthomonas axonopodis* bacteria;
    (b) the bacteriophage infects a cell by adsorption to a Type IV pilus;
    (c) the bacteriophage comprises a contractile tail with a capsid size ranging from 85 nm-95 nm in diameter;
    (d) the genomic size of the bacteriophage is about 190,000 bp to 230,000 bp; and
    (e) the bacteriophage prevents or reduces symptoms associated with Pierce's Disease in a plant or plants.

2. The method of claim 1, wherein contacting comprises introducing the bacteriophage particles into the plant.

3. The method of claim 1, wherein the plant is selected from the group consisting of a grapevine plant, a citrus plant, almond, coffee, alfalfa, *oleander*, oak, sweetgum, redbud, elm, peach, apricot, plum, blackberry, mulberry, olive, and *Chitalpa tashkentensis*.

4. The method of claim 2, wherein the bacteriophages are introduced into the plant by injection, by an insect vector, via the root system, by spray, by mist, or by dust on the plant.

5. The method of claim 4, wherein the insect vector is a glassy winged sharpshooter.

6. The method of claim 2, wherein the number of said bacteriophage to be introduced into said plant is from 1 to $10^{12}$ PFU/ml.

7. The method of claim 2, wherein said bacteriophage virulent to *Xylella fastidiosa* and *Xanthomonas axonopodis* species are introduced simultaneously or sequentially to the plant by a combination of two, three, four, five, or six virulent bacteriophage strains.

8. The method of claim 7, wherein at least one of the virulent bacteriophage strains introduced simultaneously or sequentially to the plant is selected from Siphoviridae or Podoviridae bacteriophage.

9. A method of preventing or reducing symptoms or disease associated with *Xylella fastidiosa* in a plant, comprising contacting said plant with particles of at least one virulent bacteriophage, wherein *Xylella fastidiosa* and/or *Xanthomonas axonopodis* are hosts of the bacteriophage, wherein the bacteriophage have been deposited under ATCC Accession Numbers ATCC PTA-122743 and ATCC PTA-122742.

* * * * *